United States Patent 7,745,391 (HUMAN THROMBOSPONDIN POLYPEPTIDE) - sequence listing, part 259

SEQ ID NO: 735308 - DNA, 188264 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735309 - DNA, 188366 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735310 - DNA, 188258 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735311 - DNA, 188215 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735312 - DNA, 188094 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735313 - DNA, 188137 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735314 - DNA, 188239 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735315 - DNA, 187923 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgtttgaagggtacttgcgggggccacaggttggggagggccctggttggggggctttctggcccgttgttcccccttttccagggtctggcccccctttggacctggtttttcccccgttgtcccttttcttaa

SEQ ID NO: 735316 - DNA, 187760 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaatccataaccagcaatactatggggcctgctagttctagatcgcgagcggccgct

SEQ ID NO: 735317 - DNA, 187664 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgccggtgactgtgacatcaactacgagggcctggataacctccgaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatagtccccactacccacatgcatgcacccataa

SEQ ID NO: 735318 - DNA, 188467 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga

SEQ ID NO: 735319 - DNA, 188424 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggctatcagcacccctactagttctaaccacatgactcctcccccttatactaatagctagccaatcccacctatcaaaagaaaccacaacccgaaaaaaactatatattaccatactaatcctactacaactattcctaattataaccttcaccgccacc

SEQ ID NO: 735320 - DNA, 188303 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggattatattatctgaagctccccttttgggcggaatgtg

SEQ ID NO: 735321 - DNA, 188346 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggcctgccatagaaaatgcaaccacagaaataaaatggattgctttttttccctgtagtgaaaatacatttaaatctatctca

SEQ ID NO: 735322 - DNA, 188448 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggttgtgcttctgcctctggacgccgcagtgcatgtggcttccccagcacccagctcctgaagcaccaggcggtcagcagctgcccttggcaccctccagccctcagaagttgcgtaggagacacagcgcctccactgaggcacctctctgggaataacgttccccagcaccccaaatggatttccagtcaattcagaagcattttaccagtgaagccctcattattccagttcactgttaaagccagtaattctctatattaaactttccctgttcggtttatggagtataaaccgaacagggtcttgggaagggacagtgtctaagtgtctgggtgccatccagagcatttggcaggggcagctgcaggatgagtgtgttcccaggggagtgagagcagcagctatatggcacttgtttgctactgccctctttttttctttttgccaaacctgaggtgactagtgtcacaggtggagcccatctcaca

SEQ ID NO: 735323 - DNA, 188340 bp, Homo sapiens
ctccaaggctgagggatgaggagacctgctgaggacccagggccttatctttccatcccactccataggtcccagtattgactgatgctgtcttcacctcctagcctcacttttaaccttctggcacccgcccaccactgtccagttcactattgaagccctgccgtccagtgctgcagagggaaaggatgttcttctactggcctgcaatatttcagaaactattcaagcctattattggcacaaggggaaaacggcagaagggagccctctcattgctggttatataacagacattcaagcaaatatcccaggggccgcatacagtggtcgagagacagtataccccaatggatccctgctgttccaaaacatcaccctggaggacgcaggatcctacaccctacgaaccataaatgccagttacgactctgaccaagcaactggccagctccacgtacaccgtgagtgattcccccatacctctgggtgctggcggtcagttctgcttcacacacatgagattgtcaggcctgggctgtgcctgcatccccctctgcattttgtcccgtgttgagatttgggcatttagtgcaggacacacacatggtaggtaaacttcaacagatcagaattcctttcctgcatccaggccctgcagacactgatggcgggggcgggggggcctcagcagggggaggtcagtctcagccaagcaccccatgccctccccatgaacctgaccctgagaaagaccctggagaactgggtcagggcctggcctgagggcgtcctgggaacctcacaaaagcccagcctcaggactcctgactccgtgtgaccccgggaagcctgtgtcagggctggggtgtggtctcctgggcagggcttactgggagcaaggatttaccagatgtctgcgggctgtggttcctgaagcttctcatcagtgagggctcagctcccagagtctcatctagacaaggacagagcctaccactttccctgggactcagcctggagagggcagggggacaggattactagggcattggccccctgaatgaggagcttaagagatgcccttgggcagtcagtggcccaggggtaggaacagaggggagaaaatgttcctggcagcttcttgtccaccggggatcatgcccaggggtgctctcccatggaggcaaataacagatgctgttgatgtgaacacctcctctgtgccaagcttcatgtcagatcctgtgaataatttaaagttcattcacagacaaagtggcaagcctcagaccattttccatttacatattgtatggaggggaaactgaggcacagagagatacagacaccggccacggtgggcagatcgcagctggcagagtcacatgagggctgtctgcagctgctgccacgtcctctccttcatccctggtgccttactaggtgtctgtggaccttagaacagccactggttcggatgttttcttcttaggtgtctacagctcggagggggagattctggtctggagagttatgagtaaatacagaattaatcagttttttcttaactaaatcacctgcctcaacaatcagtcagtgctggggaagttcaggcctcctcgctcaggtccacaccccgcatctctggacatgaaatggcttcgtgtgttttctgatgtgtgggtatcattccaacaggaggataaaggggaggactttgctttctctccccattcacaccctgcaccagccagggcccagtgtgagacacatactccgtagttctctcatgaaggagggagggaatgaatgaaggaatgatctataacctcttcagagacagagacctggatacaagatcctaggaggttctgggcccaacgtgagacacacactctgtagttctcttatgaaggagggagggattgaatgtaggaatgatctataacctcttcagagacagagatgtggatacaagatcctaggaggttctggccacacctgttttctgtccctctagagcctaagacccatgtctcattcatctggcccgtttctcctaaatctgcccctgggagctgagtctcatctgaccctggggctgcagggctgtgggaaggttttcaggggagggatcaggcttgcgggtagtcccacacgtttgccttacaccctggagctctacctggttctcactatgaatatcccataataatcccccctatcctttctggggagtagaaaaaaagtaaatatttaaaaatatgccagagcatctgttcttcttagcaagttcagatagttattagttagcaggaataaatcgttattttaccagagcctcacctgctgggggtttatgggagcctaactgactgaggggggtgggaaatatccaactccagccccctctagccatcatgtcccacctaaaggagagaaaaaactgagaggcacttgtgacattcacagcccagggcacagactctatccaggaccacagaacccctccctccccccactcaccaccgcatcactgaacgcctgctcacccaagttcctgttgcccagtacatcatgtcctggctttcaacaaaaactacaagacagactagaggcaaaaaaaaaaaaaaaaaaaatgcagttcgaaagacagaacaagcatcagaaccagatgcagatgtggcagggatgtggcagggatgttgaaattatcagaccaggaatttaaaacaactctggggccaggagcggtggctcatgcctgtaatcccagcatttgggaggccgaggcaggcagatcacctgaggtcaggagttcgataccagcctggccaacatggcaaaaccccgtctctactaaaaatacaaaaaattaggcaggcatggtggtgggtgcctgtaatcctagatactcggaaggctgaggcaggagaattgcttgaacctgtgaagcggaggttgcggtgagcctagattgtgccactgcactccagcctgggcaacagagcgagattccatctctaaaacaaacaaacaaaaaacaatactggctaatatgctaaaggctgcaatggaaagcatagacaatgtgcagaacagacggatgctgtgagcagagagatggacaggctaagaaagaataacaacagctactatatctatctatctatctatctatctatctatctatctatctatctatctatatatatgtatatatatgctagagatcaaactcactgtaacacctggatctcagagtggttgtgaggatgtttattaggagattaaagagattaaagcagagttatacacagggcgagagctcaactgatgctatcaactagtattcttatttttttgatgttgttattggcaataaaatcaggaacaatgcagtaaaaatttggttttatcatgtacgagttctgtgaccttccttgacttactgaggtactgtaagtctcagattctaactctgcagatggcggtgatgcccctctccctcaaggtgatgtgaggatgagatgagctgtaggtaggttggtgcccactgtgcctggcacatggaaggcccctgaaaatagtcaatgaacatcatccccgctcatcagcatggagttgacagtgagggctcgctctctgtgacaatcatggaatggaaaagaagaaacaagaggaagactgggcgcagtggctcatgcctgtaatcccagcactttgggaggccgaggcgggcagatcatctgaggtcaggagttcaagaccagcctggacaacatggcgaaatttcatctctactaaaaatataaaaattagcctggcatggtggcacaaacctgtaatcccagctacttgggaggctgaggcaagagaatcgcttgaacttgggagatggaggttgcagtgagccgagattgcgtcagtgcactccagtctgggtgacagagcaagactccatccaaaaaaaaaagaaaaagaaaaaagcaacagagggaagaggtgtgacatgagaggaagaagggatttaaaggtacaggagcagggcgaggtgcaagcacctgtgggagaatgtaggagttggtacatcccagtgtgtcaagtctgagacacagaaaatggtgcaaccgtggagagcaagggagtcagctatgaggacagcccaacagaccacactcaggctctggagcatttccttcctccctgactatgcccctgccctgcaatgccccttatggtttcccttggaacaaacttgggccttgtcccctttgccttcccctttctgcagaaaacaacgtcccaggccttcctgtgggggccgtcgctggcatcgtgactggggtcctggttggggtggctctggtggccgccctggtgtgttttctgcttctctccaggactggaaggtaccgcagcttttccccagcctcctcccacccctaggctgaccccagtcagggaggagggagaccccgccctgtattcagggccaggctttccgcatcctcccaaggaatccttccctctcattccatggctcctcccttgccagctgctgatcctaggctgcctcttcctttatgaatgtggcacagttaaggttgcacccctgagtgctgtcctagttccctaacacagcaaagccacagctgcctggagggaggaagggagggagggagggagggagataagacgggagtgctcagaacctggtaccttctgctgttcattgaatttacccacccagtgaggagggatttgcaggcttgagatccatggtgggggtcctgggcatggtcacgcagtggggagtggcaaagcctggacaggctgggtagggtcagcaccccatcgtgattgatgtccctgaggtgtgagatgggagaacctggacctcaggacctgctgtcctttatgtctcttgccaaggggtggagagagagaggacaaggccattgccccatttcagcatctccaggcctgaaaggagggtctggccatggcagggatactgagttctgggagaatatgatacatgctccttgcctccccatgcccccagctcccccagtgtcctgcacacacagccggccctgctttccctctggggccttgacccttcctctcaggcaaacgcaggtggtctgattccctccctgagtcctcagtccctttcctgggtccctgggtcaatgttctcctcacccggcatctgcctgggggggtccttcctctctggccaggacagacgtgactgcttaaggcctatcctcagctccccgtcctcggccgctcctaccacgaaactgatggagacaggaggccttcactccagtccttgaaaatggagtcccttccttgtcctttattctgcccctaaacctgtgatttctccctgcaccctcatgaataatcctgacctttcctagggccagcatccagcgtgacctcagggagcagccgcccccagcctccacccctggtgagtgtcccttcagcccaggtgtgggagcccctaggcctgccctacggtgtccactcctgccagtcaccccctgggggcctctgaccctttctttggggctgcaaggaggatgtcaggaaacatgacacaggggaccccgactgtcttgttcagactgatctgtgggctctgggtcgtgggtcacctcctcgacctcagctgctcaggtctcccctgggaagaggctccctctccctgattctctgggagctgaggacccctacactctcctgcaggaggggcccaggctctcctcccaccctgctgctcactcctgtctctgtccccaggccatggtccctctcacagatccaccttctcggtaagcctgttccctccccagcccttttctactggggtcccaacagtgcaggctcagggcagggggaccatcaaccccacagcacagcactgacccacctttccccagaacagtcaggtcaaagtgagtgcctccagccaggatccgggcctctctacagggccaggaccacccacgccatgtgctgacccctccccgggaccctctacacctgaggagaaccctggagtccagcaggtgcagaatggacactgggaccatcagtcagaggcccacattaacaagggtgcggggtgggcccagccaggacaggggtcagggtgttgtgtccacactgggaggctgagctcaggggcagagctggtcaatcctgaggggaaatgagtggaagtggaggcagggaagtaagtcctggccgatcagagacaggaaccttccaggctgggcttccgtgaccctccctccctgtcccctgacatctcctctctcccctgcccaggcccctctacccagccccagaacagccactcccatctatgaggtgagtgtgggccatggatgttctggtcccgcaggctccaggggacccaggatctgcccccaccagcacctggctgagctcagattcaggaaaatgcagtgaaaatgagaacaggtggtggtgagcagaggagggaggggcctgggaacagggaccccctgagcacagccaggttcagccccagagaagccctgggtgggcccagagcctgggagatgccagacactgttctgagaaggctacaggggttgaggcctcttctctgtttttacaggaattgctatactctgatgcaaacatttactgccagatcgaccacaaagcagatgtggtctcttaggttcctctgggagctgctcttgtgggttgatggagcgtccccaaagctcccagccctggggacggggaaggacatggagcctgagccagagaaccagctctgagtcctgaggagacacaggcctggggacagggagggatgggagtccctgctgaatatctggagaccctgacaggttgccctgggctctgggtgggccgggacaaaggcctctcatcaccacaggaagcgggggcttgcaaggaaagtgaatgggcctgtggcccacccggggtcaccaggaaaggatctgaataaagaggacccttcctctcattggctctttttctgctcacgggaacttagcagaaactcacctgaaactccgtgtccattctctcccgggtcacacagggaaaatatctccaccttgtctcaaccacagtctctcttccctgggaggcagaaataggggttgggagtcaggctggggtgggccctacacaggaaagggcaagattcacatgagccctgcccagccagccgagcgctcagctgtcctcacactaccccagggaccaaggccatgcacagccccagcctgggtccctctgtgaatgcatgtggggtctcaggagcacagaagatggggccatctgatgtccacaaaaggtgagcaatgcgggagcaaccatgggtggtataggttgcggctgtggcccctacgcagcctccagtgtcctgacccctgctgccctcttcacccaggccctggaggcccagtctatcactgtcctccacaaatgaacttacctgtccccaaatccaggatcctgtgtgcttatacctggccactaggttctcctctgtcccagtggctactgctcaggacatctttatccctggtggggcacagagaggggctgtcagagcaaccaagattaatacagacgcataattcagtccttgagcactacccaggactctggcccctcattgctcatcagttcccactttaccccctggcatggatctcactgagcaagccaactctttacacaggagcatccaggtcagaggtgcaggactcccccatctaaagctcatgcaggctcccatggcgatgggacaacctgtctgctcctctccctggcccacagccctatctcgcctgcagctcctccacacacctgggacagcagttctcagcccttccctgagggcccctggaagggtgatgatctcatataggttcacttgaaccaggtgccaccttcccacaagtgagctggtgcctgcactaaagcacagagccacagttcccaagagtgttctgccactgccacaggtcccaagagtgttctgccactgccacaggttgttcgtcctgagatgagaggtaagaaaacaacccgcaatgggttgttttatatcgggatttgcatcaggatttagctctaaatgacccctgatcccacctgcacacagcgtcagatgagacaaggtgaggcctctttagttttctgttgaggctgtgacaaattaccacaagcttagtgacatagaaacctgaaccaaagtgcccacatggctgtgttctttctagaggctccagggaagagtgcatttcctctccttttccacctcctagaggcctcctgcaaccttggctgtgtcctctttctccatcttcaaagccagcagcacagcatcttgaaactattctgtgccctgcttccatccccacatctccacctcctcccacctccctctctcacttaaaaggaaggagccttgtggttattttggacgcacctgggataaaccacaacaacctccccatctcatgatccttcctttaatctgtaaagtgtcctttaccacgtgacatgtccacagatctggggatgaggatgtacacatctttgagaggcccttgttctgtccatcactcctctcaaggccatcttctcatcatcgttcactacaaactacacatgggcacctggatgggttcatcatgactgtggcgtcagttcctgcattaacatccccagcaccctccagatcctgagagagggagacggagggctctccatgcccctagtacctctccaccttcttcttggtgacatgcttagttgctaagaataacagaaagcggaggtgactgaaagatcacaactcaccggcccttcaatagttcgtggacatcagcaccacggacagtgactcagtgaggctaatttccaggtggcagcagggagcatgcagataggagggaactgcaggaaaagctgcccattctattctatatgagaaagagtgtaagaaagaggaagctattacagggataatgctattcttctctaatccataaattgcgaaacctttgcatgtctggatatcatggtttttagcacatctgctgccactccctgcagggctgattgctgcatccaggatgtggtctcttggggggctcacagcctgctttggcctcatggtgagtctccctgcccctgacactcaggccactgtctctgcctacaacatggtgggaaccttccatgattaacgtctgattctctgtgcctgacctttgaagcacatccatcactcagcctggagcatccgctgagctcagcatcctgctcctccatccccagctgagcccttgaggagatgcttgagaggatctcctgggctcctctgtgagctcctccaggctgagccttgtgcttggtgtcagaggcctttgccatctgcttgttctttccataggcaaataatcctcctcagggacaagtggggcctgaagatctgtctgaatatctatctatctatctatctatctatctatctatctatctatctatcatctatctatatgtatgtatatatgagaatgctttattaggcaaaactgcatactatgaacatgctttaaaatgcaacaggatgagatgtgaagacataaagaacaagtgtgtagtgacacatggctatcagaacacactgaagaatccacaccgcggccgagagcagtggctcacgcctgtagtcccagcacttttggaggctgaggcaggcagatcacttgaggacaggtgttcgagaccagcctgaccaacatggtgaaaccccatctctactaaaaatacaaaaaatttagccgggcctggtggctcatgcctgtagtcctggctgttcgggaggctgaggcaggagaattgcctgaacctgggagacacaagttgcagtgagctgagatcgcaccactgcactccagcctgggagatagagtgaggctccatctaaaaacaaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtcctcagctgcatcctgggtggcctccttgctgttcttgtaccccagaggcaggttccaacctttgtgatgttgcctgcaatgcccaaactttcccttccccttccccttcccttttcccctcccccttcccctccccttcccctccccacccctatcccttcgtcttcccttgtcttcccttcccttccctataaagccaaacatacccatccacctaccttgtggtcaaagtcatcagcctcctgctccactcagtgttctctgaccctgcatatggaggtggtggcccctcctagaacacccaccactcactgtcagccttgcgtggtaatcacagattttgcaggggttacctgtgttcaggtgtgtcacctgtggaaccagaactcttggaaggactggcagagggagctgcttaggatatctcagggctcctggcatctggtctaccacagggctattaacaacagcacttagggacaaggtggaggatggacggttaagagggtaaatatggatgatgtgtgggcaaagaataggacacaggaacacatgcagtactcaaataattatgccaagaaaggtgaggacatggagatggacattcccatatacttctgatgggactgcagtttagtccctacagcaacattgacctcatcatgtttaacgcgcacacgctctgaccactatcctacttctgaaggcctccctgtgctgtgagctctgagaaggccaagcttgcctgttctgtctctgctaaagccagagaccagccaatagcccagcacagggtacttcataaatacatgttgaaggaatgagctccaggaacagtactccacatggtagagatgtgtgtatgaggatgttcactgcagaaggtcatgtcaatgtgacaagtgacgagcagcctcaaatccagcaacaggggtgtgggtaaaagatcatagtgtagccatgcaatggaaccaatgaaaaaaccacaattagagcaaatccacatgtattaataaaggaggtgccctccatacatgctgcacctaacagaatgttgccaaataagaatgaaaaatgatgatatttgggctgtaaaaactagaagtcagctaaataagaatgcatcgaaagtatttgtgaatgcttacaattttataatgccttggcatccgttttggatggaagttggactttctcataccagaagcagggctcagtcacctttgaaatagtttccagttctccacctccttccagttcctcagtgtgattgatcagatatctgatttatacaactgcctcctggtgacctcctccctatgggacttccggatacagcccgtatgactgccccactgaccccacaccctgcctgctgcagtgaccacctctaattacctggatctcatgtctgcttgcattaaatccaccaattaaaactccctgaggacaatctgtttgaataatattctgtaccctaataaaggccttgacccatgggttccccctctgtcctccccatactgcccctgacctctgtgtgtgtgtgtgggtgtgggtgtatgtgtgtgtgtgtgtgtgtgtcctccagacagggcctgtatcccccaggacctgtaagtaataaatctttattttcatcttatgtctctcgcaatcattggcaagagctctgcatcttaaagatcgcaaatttaagaaattggtgtagtcggcacaatagagtacctcttctgtttagcacaagatatctcggagctgctgaggcttttaacatcctcgccggtgtggctgcctcactggtgaggccgttctgttcagtgcaattcagttgctccactgtgtgctgctgtgttgctgctgtagagtgctgccatgttgttctccccaaattgttaccgagtaggaacctgtaatgtgctcccaaggtggtctaccccatgagaagggggattctccatctagggcaagggctaggtgtgtttctggaatcctaatagggaaggcatccacagagggtgaactccactcctccttagagtgaggagtgacatttcccatttattttccccatggaggtgccatgtattgactttttctttcactgtcccaaggttgagccaaggtgagctatggagaccagggcaagataccatttctgttagcaaagcaaatgggtgacaacgtgtggagaagctgtggttctcctgatggatatagcagagtgccatttagtaaaatcttgtcaggaggctgcccctggttagaccggcagtgtctgtagtcactaaggtggatgcgaattttaggccctgggccatggataatccctgcagacacagccgtggcttcatgtgatggggcaatcccgggctagtggctcccttgtttctgcatttcttgctgtggttgcacaatcaacacctcaggggttgattgggtcaccttggaaagagaaacagctgcctaggaggctggtgcacatggaggccaccctcaattttattctgctaacaagttgtaagattaaaacaacagggggctttgggtaccatcaggaacttgtcaagtaaacatccaaagacagaaagaagaaaaagaaaaagacattaaccgtctagaaatacaagccattttaaagattttgcttaaaagatgcgcttgggctgggagcggtggctcacacctgtaatcccagcactttgggaggccaaggtgggtggatcgactgaggtcaggagttcaagaccagcctgaccaacatggtgaaacctcgcctctactaaaaatacaaaaaattagcagggcatggtggcaggtgcctgtaatcccagctacttgggtggagaatcgcttgaacccgggaggcagagacggcagtgagccaagatcgcaccactgtactccagtctgggcgacagagtgagacttcatctcaaaaaaaaaaaaaaaaaaaaaaaaaagacgggcttgtttcgtcgttgtggagtcatcccagagagaggctactccctagagtcactgaccacctttcctcctccatcttttcctcttatcattctagagacagaaaacaagaatctcagctttaggtggctaacctcaccccccaagaaaagaaactaccactttgattgactacaaatccaagaaaaataaaagagaaactttaaaaagtactgagcaaaccacaggtctagcaaacataatgctagccctaggttacttattcatttacaacaaacccctagatataggaggaaaaaataaaaggtaattaaatatatacacatacaatattttaatataaatatataataaatagttaaattatgtatgtataatatgtaactaaatcaaagtaaaatttcatactttgattctattggaaattcaaaattcatttattaacttatatattaaggaatttatgtaaaaaaagatttttaaaagggcaccaatttgcttttgtgtctctacaacataggatctaatttaactttacatttgctaaatacactaattgacaaatattcatggatttaatcaatactggggctcaaattgtagccacacgtgggaatcccataaatttaaacactctgtccctattatcttgagaagaaaactaaatataaaattgaaaaaaacaggtatgtctcaatttacctgtaactttgcctaaatttcccggagtcatatacccattgctgtaaaacattctctattggacataggtgctctgagacaataaataaaatagaagtgtttttggtacttagacattggcttgacaaaatgggatcccatgaaacctcagttaagatagtgaatacggcccaatgtgagttgaaatggggcctttaaggattaaaacttattacatgaaacctagtaagtaatggggtgattatccatactgcttctccatttcatagcccaattttgacagttgtcaaatctggaaaaaacaaacaaacaaacaaaaaaacccctgggaatctgttgcctcacagagacacaaagtagacatcaaaattgtatatctcagttccagttccaaaatggtggcatagaagcaagctggctttactccttcacacagaaaaccaaaaacaaatatacagcaccaaaattattaccagatatattccagaactcaaatatgaaaatgaaacagttttcagagccacagagaagtgaaaaaaactcccgacagatgacaaaagaatcagatttccccatctgtaatgtccctccctgccccattctgcctggtaccaggtgtgtggaaaattttaccccaactcatggtttctacactgggaaatgtaagatcaatgcgggcaaccagtttctgcacaatcctgggttccctgtccctgccttaacccacaagaagcattgtgagtgcccgaagggagaaatttccctgaggacagtcaaagagtggggaggcaggactaccatctccttccctggaaactctgctgtgtaactcagccaagggagacatgaaatcagactggtgtttcagcagctccatgttgtagtaggtttgtttcacaggtatcctgggcatggacatctagccagctttcccacactgccaggatatcccctttgggacctccctcagttaggaagggcacactctgatcatttactagggccaaggtaaaccctaaaggtaacttagagatgaaaaggaggtagtgacctagcagtaaagaactctaagaaaatctatccaataaaaatcaaaacaagccagacaaagactaaaataaataatgaatccttcaatgtaaagacctggacttacatccacaagaaacagtaagcaggtaaccatgatctccccacatggacaaagtgaggaacaagtgactgatcctgatgagatggtgatgtgtgagctctctaatcaagaattcaaaactgcagttttaaggaaactcaatgatcttcaagaaaacatggaaaagcagttcagaaatttatcagagaaatttaacgaagggattgaaataatttaaagaaaacaaacaggaatcttggaattgagaaatatatttgctgaacaggaaaatttattagagtctctcaacagcagaatggatcagaggaaagaatcaacccaaataagactcccccaaggcataaaataatcgaattctcaaaagtcaagggcaaagagaagattttaaaacagaaagagaaaagaagcaaatggcataaagaagctccaattctgtggcaacagattttcagtggaaatcatacagaccaggagggagtgacatgacattctcaaaatgctgaaaaaatattgacatttgagaatactttatccagtgaagttatccttcaatataaaggagagagaaagtttcctagacaaacaaaagctgagataattcacaccatcagactagtcttcctgtaaatactaaagggtaaatactaaatacttcaatgtgaaagtaaaaaaaaaaacactaacatgcaaaacaaccacaacaacaataacaacatttgaaggtataaaatccactggtgaaattaagtacgtagacaaacccagaatactcaaatagtaattgtggaaagtaatccaatcataactctagcatgagtctcaaaatataaatctatcaaaaacaataatacattttaggaggccaaggttggcagattccttgaggtcaagagttcaagaccagcctggtcaaaatggtgaaaccccatctctaccaaaaaatacaaaaatttgcagggtatggtagcacatgcctgtcgtttcagctatttgggaggctgaggcaggagaattgcttgaacccaggaggtggaggttgcagtgagctgagattgcactactgcactccagcctgggtgacagagggagactctgtcttaaaaaaaaatagctacctgtttggagaaaggtaatataaaatatgtaaatagagacaaagtcaaaatttgcaaaggatgaaattaaagagtagagtttttttggggggttttctgtttctattattttatttgtgatctaagataagttgttaccttttcttctcttgaagatactttgttatatctatgtttttggaagtcttatggtaactgcaacgcaaaaaatctatgatagatccactgaaaataaaaaacaatgacttaaaacatactaccagagacaatcaaccacaaggaagacagtaaaaaatgaagaaaggaagaggggagttacaaaacaaccagaaaacaggcaacaaagtggcagtagtaagttcttacttaaaaatattgaacactgaatataaatggactctattctccaattaaaaggcatagagtggctgaatgctgcctatatgctgcctacaagaaaccacttcatgtaaaaagatacaaatagactgaaagtgaagggggtggaaaaagatatttcatgcaagtggaaaccaaaagagagcaggagtagctatactgatatgagataaactacaaatcaaagactataaaaagagacaaagaaagtcactatgtaatgataaagcgctcagttcagcaagaggagatgccaattataaatatctatgcatccaacacttgagctcccaagtctcccaagtatttaaagcaaacaatagtggatctaaaaggagagatagactgaatacaatattaattaggggactttaacaccctgctctcagcaatggccagatctttcagacagaaaatcaacaaggaaacttcaaagttaaactacacactagatcaaataggcctaactggcatttacgggacatttcactaactatctaactgttacagaattcacattattttcatcagcacatagaacattcttcagaacagaccacatcttaagtcccaaaaccagtcagaataaattcaaaaaagtttatatcacatcaagcatttgttctgaccacaatggaataaaactacaataaatgaataactttctggacacatacaacctaccaagatggaagcatgaaaaggcagaaaaacccaacaaaccaacatgaaactgtaacaaaaggaaaacccaggaccgaatgacttcactgctgaattctaccaaacatttaataagaactaaaaccaattctactcaaaatgctttaaaaaattgaagaggatggaacactttcaaactcattctacaaggtcagcattatcctgataccaaaaccagacaaggacaggacaaaaacaaacaaacaaacaaacaaacaaacaaacaaaaaaacactacaggattgcttgaggccaggagtttgagatcagcctgggcaacatagtcagaaccaatctcttaaaaaaaaaaaaaaagaaaaaaattagccaggcatggtggcatgtgcctttagtcctagctactcgggaggctgaggtgagaggaccaattgagcccaggaggttgaggccgcagtgagccatgtttgtgtcactgtactccagcctggggaacagagcaagatgctctctcaaaaacaaaaagcaagctgggtgtggtggctcctgcctgtaatcacagcactttggaaggctgaggtgggagaactgcttaagcccaggagttcaagaccagtctggacaacatagggggactccatctctcaaaaacaaccaaccaaaacaaagccaaaaaagaacataggccaacatcactaacaaacatagatgtaaaagtcctcaataaaatattaacaaaccatgtttagaaacacatcaaaagagatcattcactatgattaagtgagattcatcccagggatgccagtatggctcaacatatgcaaatcaataaatgtgatccatcacattaaagagaaccaagaacaaaaaccatataatcactccagcaagtgcagaaaaggcatttaataaaagaatgggttgagggagtggagcccatagtcagagcagcagtggtctgggattttggaagtagaaagaagggcagcaccactggccaggaccaccagggaacacccccataggccctgggtgttgtgctccagggagggttccctctggagttattaatcttggtgtccactttgcccagctgcccctcacagggtcagggaggatgaagggaaagcttccttctaatgaaagttcagggactcacagttcctagagcctgtagggagaggaagatcttcgaggaagagcacctgggcattggggcgtttgagaggaagatctatgccaggtccaagtggacaacctgtggactctctctccagggacatacgggtatctgggaatctcctgtagcttaaagaggtaaagacctctccctttagcctgaggactggaggatgctggttcaggtgaatgagtcctgcaggggctggtacaggcctggagggtggtggtgtccagggccttgggttcacccttagcatgattcaggccgggcggtgtttcacatgagcaagagggcctgggttcattgcttcaggacaatggtgaaatctcatggtggaagaaatcttgtccttgccagtgcccagctttcatttggtcttggcccagagtgtcctccctagagaagactcttgtcccttcttcacactgcccttcagggatatgccagccttatgggataagatggggtggagactgtagatgtgggtgggaatctctccacagagtgctccttctctcagcggttgcaccttgtctcagggcttcagcttgaaatctgggatctccaagcccttccctccccagtcctggccaggaccacatgggcagatgcattgtgtgaagtgcatttcatttggggtgtcctctctgcatggcaccctcccgttgattctctttgcgcatgtcagagtgcaggcaccatccacacctcctgctggaggagggacggagctgttgactcctgagagctgatcatgtgttcccaccctcacacacaatcatggtccatcctctgagggacatgtgttgccaccactgtggagatggtgcaactgacagtaacaaacagtaaaatctggtactgaatgggaccttaagccaacaatgacaatgtcattccaaggtgtttcatttttattgattcaatgcaagtcacctgatttcattgactattcacaatagctcgataaagtaaatgcatcatcaccaccactttaaagaggaaaaaggtgcttgggcagtttgtgactactgtggtggctgctgcattgctctctggtaaagccaagtaggtggtgggtgcggcctctgggctgggatgatccaccctcctggtggtggcaggggagccaagctggagccatggcctgtgcagtggtagcagctgaactgaccgctgctgcaggatttgcaagctgttacattttgcgaagccatgaagcacataaaacctcaagtagaacaagtgtttcaaagtctaccaaaatctgccttcagagattattactacagaggtggatatgaacccaaaatgacaaaacgggaagcagcattaatactagataatgaatgaacactagtaatagtagggtaagccctactgccaataaagaaaaaaataagagatgctcattaacatgttatgctcttaaatcacgcagacaaaagagggtctccttatatagtagccacaatcaatgaagctaaagatttactgcaagatcaagctaaaaacagtaggtgtataatgaatttttaacttcatattagtttatgtatatgaatatcaagtttttataataaaatgcctccaaacaaagaatatttgatttagggtttaataacttctaagaggggactcagatgtttcctgtttcacagtcagtctgagagggtcatttttcctggagctgacctgggtggaggcctcacactgatactccccagcatcctctctcctgatggggtttatgctgagcatacagtggccctgggacagctccattctctccatgagtcacagacgctggtcatggaagatccactggataaggttccagagtcatctgtggggcaggtcaggatcacaacatccttttcttctgtgactctggtgttgctgactcagatggggtcggagccactgaccctgtggacaatcagtggaggtgctcaactgaaagtgggctgagggcacgtcttctcctccatccctgggtccttaaggtaactgtggaccccagaccaactgacacaggagctagaaagaaattatttaggaagttagtgagggtaagagcgtccttggcaaggtttcccctttaacaaaaagcagcccaagataattccttttctaacaaagagcagcctgaaaaattgagctacagatgtagatgagcaagatggaagcttgcacaggtgaattccagtaggtgtgccaatagaaaagggctgcctggaagccaggtatgttcaacatggagactccatcctcccttttctccattaccacatgtacagtaaaaaaccaggcaacatggcaccggccaggtagacaatccatctgcatgacaaaagatcagagtggggcagccagcaaatggcacagctggtctaaacaatctttcaccccctgtataaatcagacactgcctcctgaagctcatctataaaaccttctgcatttcactatggaagtggcaacccattttccccaggacccctctctctgtgcagagagctcttctctttctttcccctatgaaacttccactcttaacttcactctgggtgcctgcatcctagttttccatggccatgggacaatgaacctcgagtattaccccagatgaatgatgctgtttcacaatcactggttcagctcccttcttcttagggtttcacagctcggtggggagaataccacgcctcagtggtctggggagtgaggaacaaatgaagaattaatcagattttacttagaacgctatcacctgcctcaaccatcagatccatgttgggaatgtccaggcctcctctcttagatctatacccacttcactggacctgaaatcctgtgtttcccgatgtgttggtgtcactcctatgagaggataaaggagagaactttgctttctctccccactcacaccctgcacaagacagggcccaatatgagacacacactcgctcagtagttctctcatgaaggagggagggagtgacctcgagtgattctgccatctgtagtctgtgtaccctggccagtggctgtatcttcatatgcctcagtttcccctcagtaaaataggacacacaatgagaactaaaaataaaattctaattccccagtgaactgaaaggatggcctcttggccaagcggatcccagagttcctgatcatgacaggatgggaggttacacctcattacagcccctccctttggaagtttagaggtgacaactgactagcattaacgctaaaatcgagatcatgagactgacagaacagactctctgtggccataagataccaaattataaactcaacctaaggtcatgcaggcaagggctaagccacactttcctacatttaaagaataagctatgttctaacacagaattttctttctctctagcggctaaagtaacactagccttcgagataagcaatattgaaatgatcgcggctcatccaccaacactggctaactgacccctgttccaacagccacaactacacttcaattggacaggagactgatttcagtaactttctcctaataagagaccactgagcatggcctggttctgctggtatacagacacggtgcactgagtaccataatgcttgtttcatcttttgatgtataagacctaatttaatacatttaaatctgaattctccaccccaaagtgaacatggggtgcatgtagcatgcatgtttgttgatcacgcatgtgcgtgtacttcctttgtgagtatccatagctccacctataacctgttgaatatgtatacctggccaactcattcagcataaatctatcttccacattcccctcccttgaagtgcctgctattggtctctgctggaggctgcatcttctaccctggggaatggccagcctgcaggctgtaaccctgtgtaagaaataacctggttgggtgcagtggctcacacctgtaatcccagtggtttgggaggttgaagtggtagaatagtttgagctcaggagccagagactagcctgggcagcatagcaagatcctgtctcttaaaaaaattttagggaggagagtgaggatcagaaaaaatacctattggctattatgcttagtacttggatcatgaaataatctgtataccaaacccctgattacatatataacaaacctgcatgcgtatctttgaacctaagataaaagtttgttttaaaaactatctgggtgcagtggtgcatgcctatagttccagctactcgagactgaggtgtgaggagtgcttgagctcgggggattgaggctgcagtgaattatggtcccacctgtgagtagccacttcactcaaacctgggagacagagcaagaaccggtctctaaaaaaaaataaaaatagaaaaataaaatgaaaaatatatgaaataaagtctcctttccaaacgtacagatctccgatttttctgccaacaatgataaatggtcagtggcttgccatgttgtctgtgaattacttttaaaatattcacgatcacctgacctaaaggttggtaccaaggaaccgcctgaatacaccgtctctgattatttgcctccaacagagtgttccctgggcctgatctctggtggacaatgagctgctgggaacatcctctcttctctattcctcccctggggatgctgaccttcccttggagtctcctaagttccccagggcagtcggctaatgtcctagggagcttacctgtcttctccataccaagtctcatgtgaaggacgaggctttgcccttgcccagatgaggctctgggggctgagccctggctggctaccagctgcaagagccatggcccttggacagctggtaaatccttgttcccagtcagccctgcccaagatgcctcaacccagccccggcacaggcttcccagggtcacatggagtcaggatcctgggacaggggactggacaggggtttccagggctgagtttctgaacaggggcttcccaggggtcccctcactccaggatctgacatggtcctacaaggaacgtccatggggaggggacccaggagggggaactgacactgacctccccttactgagcctccccccaaccccatcagactgtccttcctctgtagcaagtgcctgcagggtctggatgcaggaaagaaattctgatctgtggaagtttgtctcccctgtgtgtgtcttgcactaaatgtccaaacccccaaatgggatgtaatgtagagggggacacaggcacagcccaggcctgaaaatcctgtgtgtgtgaagcagaactgacccccaacacccagagctcatgagacatcactgtgtacgtgaaactggccagttacttcttcattcacaagatctgtttttatgacttgtagggtgtaggatcctgtgtcattgttggtgacattctgtatcagcagacatgtattggggtatattgtctctcagcctctgtggcaggtcctggggtaattacttgagttcctagtacatatcctgtaattcccctttgtaccagttgtagccaagcctaaggcagattgtgggtgagtggaagaatctccttgccttctgcagcttcaacagtgacttgggcagtggtaggcaagttccagaaagttaaaagtgaggctaggagtggggagagagcatcagttaatactgggccctatgcattgaggtggaaagatggggccctaggtcctggacaggtctcttcatccctcagccttggagtgtgtgtgtgtgtgtgtgtgtgtgtgtgtgtgtgtgtgtgcgcgcgcgcgcgtgcgtgcgtgtcctactgggccaaggtcagcagcatgacctcccttccttcagtgcctctgaccttggcatttccctgtttggagtccttttccccaggggtctgcctggctccctccctactgccttcaggtcctgctcacattagggcatccttgggagaccccttccctgacacctctagagaccctgggtcttccctttctgacctttcgctgctgtgttccctccagggctcttgtcaatacttgacctcacattctagatacccttgcatgtctgtcttcctccctatgagagcatgagctctgtgagaacagggacttgtgtgatcttggttgcaccccagtgcctgggacaggctgcggactcctgtggatgagctcatgagtgttcccagggcccttcacaacgtgggatttattttccaatggctgaggttgttggctaagagctctgttggagttcaatcaggctggtgggaaaaatattagagatagttatagagatagacacaaatcttcttggaagaccaaaaagtttgcataactttggtaatagatctgactgaaggtggtccctttacctttagttaaacaaattaaagtagtaacaaaggaaggcagagtagtttgtctagccagcttgtttactcatgtgatcttaagactaaccattgatgtgccacaggtgcttaattgctttctacttgggaagtccacaatgtcaattaccctctaacggtgttgactcaagcctttgttaattaatcttactgaataaatatgagtctcactagctgatcaaggccatggtcacaactgtttataggactcagcagggagtctgtaagcggccctgacagactcagctggactggcaaagcaaaatatgtgtgtgtcagtgtacactattcacccgtcccccacagctggtgcccctatatgaggagtgctgccacagagctctgtttagtgtcccttgttttttttcttgagtattaccccaacttaaattgtgattattgtcatctgttttcaacattaactgctcagtgatgattcacttggaaaacattaacaatcgagattgtttcttcactaacaacctcagattatttagattttcctgttgtaatcccttcttcctgtttagtgtccaacagaagccctctgtccctctcaggtccccgttctctccaagaaaccccagccagtctctgtgctccctcctcccatccactcccagggagccctcccctcacctgtgagcagaagcgcctgccagggatgtgcactctgtgaggaggggctgagggaggccccatgggctctgctgtctgctttgtcctcctctgtggagaggagcttgggcttcagaaaataaggaggccagaaagtaaggaacaggctgagaaataatggggatgtgtcgaaaggtcacagatgccaacatctttgtcctatgcaatattatccataaaattacaggtttgagatatgcttaaattttcttctaacatgcattaaaataaacatataacttttaatagttatattaaattgtatttaatataaattaaatgctcttgtcagagctactgtgactgtcagctctgctgtccttcctctctctgtgctaagcctcctcccagggcagaagcacttcccagggccaggggtgggggcggggaaaggtaagtggcaatgaggatctgcacaggtagcctttccgcctcctcccctctcagtcctgcctccttgtcttcttttcctctttttctccaatctacatttcagttccttagaccacgctgtgagaagcaaggcttattgggacccccatcccttaacaggatgacctgtgctccccataagtgacctctgctgtgtctagggattggctctgtcagcacctcacagagagtccctggggcccccaaactcagtgttattttctctatgacacagaaacccctctgggtatgcaaggttttcctcatgttttctaatgtctgggaaggttggatttactcccagcagggaggtcacagagatgtccagggagtggggtcctagaaatggacaaatctagagctaaagcccaggtctacgattttcagttgtttttttctgcagtgctatgtgaccctaatttcctaggagtaactaaaatgcaaacctcagacatttgtagacattttatgatttttctctacagcttgtaccactgttattattatttgctttatgctttttcctaaataaatttactttacaaaacatccttgtcctagtagggtgcaggggctcacgtctgtgatctcagctgcttgagaggttgaggtgggtggattgcttgaggacgggaatttgagacaaaacatctttgtcctatgcaatattatccataaaattacaggtttgagatatgcttaaattttcttctaacatgtattaaaataaacatataacttttaatcatcatattaaattgtatttaatataaatttatatacaatacatttttatataataaattatatatataaatgtatatataatagtttttcttttttgagatggagtctggctctgtctcccaggctggagtgcagtggcacgatctcagctcactgcagcctccgccttctgggttcaaacgattctcctacctcagcctcccgagtagctgggattacaggcgcctgccgccacgcccagctaatttttgtacttttttagtagagatggggtttcgccatgttggccaggctggtctcaaacacctgacttcaggtgatatgccgcctcggcctcccaaagtgctgggattacaggcatgagccaccatgcctggcctatatattttatataattatataaagttttctataataaattttatataataatatataaaatggatatttatttaagataaagttattagttttatatatttacatatatttaggaataaatgtgttactgtgggagcccagtgcccaggcaggtagtcagtacatgatggttgtcattagggttaatactttggaattctggattttttcccaagagagtgtctacgctggaatattgggcttgtggctttctgctgatgtgcatgtgtgaagaagctacttccacttattaggacttgtgtatctgtctcgcagtttcactacctattttctcgtgatgttggtcaagtcgcctaacttttctgtgcctcatttacctaatttgtagaatatgggtaacagtacacaagtgtgagtgtgtatttcccaggactgaccactagagggcgtgaaggcaccggcacttactattacagcaatgggtgtagtagtgctcatggtcgtaaacatcattctcccatgaaaggaaccagggcttcctgggagaaataactgattccagggctggggccggaaagcacaagcggagcctggagcatctcgtgaggccagaaagtaaggagccggctgaaaaataatggagatctgtcgaaaggtcacagatgccaaccagaaggagctttgaatgaccaattttgagacaaaatgagcactataagaaataatgatagtaataaattccaacccataaatacccatgagttcctactaatataaataaataattgaatacataaatatataaggatgaagaaacagctttttcttacagcagaattccaattaatgaatgtagaaggaatgatcaaatagaaaatcactatttggctaacagcacagtcaattgtttgtaggcaagaattatcaatggactttaaatatgaatgggtaaaagtatgatgatgctacaactagtgagtaccaagggggaaaaaaaagtacgttgagaagaaacaggctacttccatattcccaaagtatcacttcaggagctacttattgattataatgggacaaatagtaacttacagtagagaaacctggcaacagagtctctccgaggtacaaaggctctcttcaggaaggaggtaaggggaaggaagaagaaaacactgtcctgcctcaattatttgctttccccattctcaagtgtacttcatagacattcaaagatatgtgttgatagtgtccacgatccacatggctctattatagtcatttattcacacatacattcagtgaggctttgagtgcctaatgtgtgcctgatatttgctagatggtggatgctgagaagatcaggtgtgctgctgtctctagggtgactgaatccacctgccccactttacagatgtggaaattaaagtgaaaaggatttataggattagttcactgtcacaaggtcactagccttaaagttacaggagtaaagcaagtttcctgacttgctagattttctgctgcaggtgctgacaatggtgagctccaataggagagaggacactcagagtgaagtgggagccctgaacaccctggattagccaagaggacatgccgggtccagctgtgaccgcacaaaggaccattggggatatttgtattctctttttcacttagagcttgaaatgaggaaaactaagtgcagaaaaccaagagtggaagatttttcacaaagcactggtaacatgcatcagaaaaccctgtgctgatgtctgtcacggtgtttctcactgaacggtaatagtctggctttgagtgtgttccctctacagcctggagttctgcgaggcagggaccaggtgtgattcatctttgtctctccagtgacagtacacagcaggctctgataaatatttcttacaaaataaaatggaataaaaagtagacatctgcacaggtgtgggatgactgagcagcagcagaagcaggaaaagtcagcgtccccagatcagctgatgtggtgttcggattctagataggggtgaggtgccaggatggggatgggggtcctgtggctctgctgccctgggggacacccctaggtttcacagtgcctgctgtggttgctgcactttgcttccccatgggaaagtgatcagagggtgtggggcttcaggtgaccccatgtgggaaatggccaagggaaggtggggtgggcggcacatggttttttttaaccaatatttgaaggtaggttgtatgaaaaggtgttaggcttatttcagcttatggggagtaggacagggattggtgagtgtgtatcaggtatattttggctcaggatggaaaagaactgtcacagtaacataaggtcttttgggaaattacatgtttactggcagagttcaggccagggctgggtgtctgaaaatacctgtcagggtcacttttatggttacaagggcagagcttggcttggaaccaggtttcttactaataccacatattaagtattataaaaactgtcctttgcaataggacattgctctatgatgcaggttgaggtccctctgtttaagtaattgtgggtggctgtgattctctcatctagtctgcgacttggacttcacctccatctgcagtccctctcctttgctgttgacactggtcagagttaagcgcatttactgacgatggtcacagggtggcagcactgcctctctggtattttctaaaacctcttcctggaactgagccagtctaagaggatgtcatgactaagaaaagggcactaatgaggtgaacagataattttttttttcttgtttctcctgtgaagtaacagagtggaggtgagcatggaataattgccttttagaaatggaagacaatggagagaagtgtttcgcaaaccttaatgtgttcacagatcccacacagatctttttattcaatacagattctgatttttctggtgaggcctgagattgtgcatgtctaaggagcttttggatgatgccattgctgctggttggcggaccacactttgagtagcaaggctcgaagatcatttagaggttaattctcactgcatctaatttatggatgaaaacaaaccaaggtccagagagagcatatacagcttgcctaacaaagccattccctaagtgcctgacttcttgcatttaaacccagggcttcagcctttgtccagttctcactccacacatcacacggtttgttcactgttgtgaacgacagttgtggcagcatctctttagtttaggaatccagagccccaatttcactaccctctttggtcttggctcatgctgtgacttcgaatagttttgcccttacttaaaatcttcagtggctcttttgtaatcacaagatcaagttcgaatatctctgtctagtgttcatggctttataacatatggtatctctttagtaaccttacctaacttccctgttttaaaattgtctcttgctgccatagccctccttgctccttcctgctccctaacaaactgtgttcacttctctctcagtggtagtgatgatggcatggcctctgatgttagactcatgtaacttctaatcccagatccaccaccaacattggcaagttgattcatctttctgaggataagcatcctcctctgaaataaacttagatggcggttgagaggggtaaataaaataacacacaaacccactctcatccctgagaccctcttcaaaactagcatataaaaatagctatttgaagaggttcagtgaaattcaaggtaacacagagaaggaattcagaatcctatcagataaatttaatagactgaaataatttttaaaaatcaggcagaaattctgtagctgaaaaattcaattgacaaaccgaagaatgcactaaatctttcaacagcagaattgatcaagcagaagaaagaatttgtgagcttgaagagataatatatgaaaactcagagtcagagagacaaaagaaaaaagaattaaaagaataatgcatgcctacaaggtttgattattaagctactcaaagagatacaagagaagggtgaaaaccaacataaagaaatgtaaaaaacaatcagaatataaatgaaaaattttctaaaatgctagctagtttttttttgagacaggctcttactctcatcacccatgctggagtgaagtggcacagtcatggctcactgcaggctcaacttcctgggctcagatgattctcccacattagccttccaagtagctaggactaaaggcgtgtgccaccaggccaggctaattttttgtatttttagtagagatggggttttgccatcttacccagggctggtcttgaactcctgggctcaagtgatccaggagattcactgccaaaaaggatataaccaagtcatatagtcataggttatctaaagtcaatgtgaaggcaagaattctaagagcagtgagacaaaagcatcaattaacttataaaggaaaacctatcagtctaacaccagatttctcatcagaaaccttacaaaccagaaggtattggggtcctaatcttttggcttcttaaacagaatagctctcagccaagaatcttgtgtagagtgaaattatatttcaaaatgaaagagagaaatacagtctttttcaggcaagcaaatgcttcaggatttgtcacggctagaccatcctacatggaatgttaaagggacttctaaatcacaaaacaaaagatttaaatagaacagaatagaacctcttgaaaccaaaaaattcaaatggcctataaaacaataacacaataagaaaacaaagtagataacgatcaacatgatgactggaacaaatattaacattgaatgtaaatgacctaacactccacttaaaagacacagattggcaagataaataaaaaatcacaaaccaaatatcagctgtcttcaagagactcacttaacatgtaaggattcttatagactcaaggtaaagagatgataaaagatattccatgcaaatggaaaccataagtgagaaggaatagctatccttatatcatataaaacagactttaagcaacaacagtaagaaaaagacaaataaggcaactatataatgataaaaggatcaatcaaacaagaagatattacaatcctaaatatatatgcacctaactttggagctcccacattcataaaacggttatgatgagacctaagaaaaaagatcaacacaaaacagtgagggtgtcctgggttttctttttattggacagcagtgtactagcctatcactttcccagtcaggggatttttggtctccccattcccctaccatgggttcatgccaaagtccatattttttattagtgtttggaattggattttttttttttgaggtggagtctcgctctgttgcctaggctggagtgtagtggcacgatctcggctcactaacctctgcctcctgggttcaagcaattcttctgcctcagcctcctgagtacctgggactacaggtgcatgccaccacacccagctaatttttgtatttttagtagaaacgagatttcaccatattgtccaggcttgtatagaactcctgacctcatgtgacagggaaacaggcactcagtgaacttcatgcgattgaggagttaatgataatgagagaagggctgtgaggggacagcactggggacaccagagcctgtgacgggctgagttgctgtgccttgggagatgcccttttgactgagccctgggaaggagggggtgtgggggcaggagctgcctgcagagggagtggcctcaggtgggcggccacctggctgcagggaagaggtgacagagttcgtgtgcagagcttggagggtgaggaggaggtgggttgaggtgaccttggtgagggtgaaccatggggggctgtgggccctgctgagggaggccagccagccctggacctacagggtggtttggtcttttttgtcccattcccagcatccactgagtggtgaaactctgcaggccagggaccatcccactggccagaaggagcgcacagtaggtgcccactcagtgcatgttgggctggacagaacctcactctgccccctgcccccagctttgggagctgcagcaaggtccctccccctagggatctccatgcctctgtctctgaggggtgagatggggagacttcaaagggccatctcagagtgtgggggatagagacgcagaagtgtgggggatagagggaggcctgggctctagacccaaaggaccttacacacctcctgagtcttttcaaatggtttcttctgttactttaaaaatgatgtaagtcatcatatttattgtaaatcccaggaatctaatcatgcgtaaaataaggtgtcttatccttgaccccaccccttccccaattaaatttccaggatgttaccactgtttgcagttggtgtgaatctctctttaataatactctgtttatctcacttgtcgttttacgccaaaatacccattgaattatattattgctgaagaccattcttttttttttttttttttttgagatggattcttgctctgttgcccaggctggagtgcaatggtgtgatctcggctcactgcaacctctgcctcctgggttcaagtgattctcctgcctcagcctcctgagtttctgggattacaggtgcacaccaccacacctggctaatttttgtatttttagtaaagacagggtttcaccatgttggtcaggctggtctcgaactcctgacctcatgatccaccctccttggcctcccaaaatgctgggattacaggcatgagccaccacacctgcccagaccattctgttctactgaatcatgtgtggtgggcacctcttatatcaatacatatggattttatcttgtgtttgttattggctcccctttttctcattgcatggctacactcaatgctttgtccacacccctgttcctgggttggaatcttgtgacagaaaatgaagtaacaaaggctaaagctttctaaagtggagtcaggagattgcaagacaattgcactttcaccagcaagagctcaaaccacagaatgttccaatagatttggataaacagctgaagtcagtattcaccagccttcaacatctcaactaggagaaccctaaaattaactaagcacatagaatggaatggacttgtgatttaggattccttctcagccaatgagctgcttctgaaaacaactttttgtggaaattacctgtaaagaaaaccctctcctgtgcttgtcttacagaacactagtcagggctgccctgattcagtggacccgaattgctattatttgtttcctaaacatatggtattttctgtgaccttcatctcaatcttttttttaagttactgggctgtttcccagttttcataatgacgagacattctgcagtgtttcatacacatgtcttttccccatgtggagtattgatccaggagctcattcagtcaacgcatgtttatgaagcatcctgtgccaggctgtgggctggtcactgtcttcagcagagagaggacaggcacagtcttgccttcacagagctcacagctcagggaggctcttagaagtgggatactggtcggagcatgtgcacattaaacatgatgaggtcaaggttgctatagggactaaaccacagtcccaccaagatcgcattgagttcctgtggtagaccagaggtcagggcccctaagatgtcctgagcagctccctctgctcagaagttttggttccacaggtgacacacctgagcacaggtgacccctgcagaacctgtgattaccacccaaagccaagagtgagtggtgggtgttctaggaggaaccgtcacctccatgggcagggttggggaagactgaggggagcaggtggctgatgactttggccagaaggtagggggatgggcaggtgtgcgctcatagggaagggaagagaagggagggcattgcaggcaacaacacaaaggttggaacctgccttcatggactgagaaaagcagggagtccacccaggctgcagctggggagggaagacatggggagcagtgggtctaggggagaagcagactgcgattgaccttggggactgggcagtgagcagaggtgtgttatgtgtgtctgtccccatcatagatatgaggaggggtgaggccgcgggtggcacctgggtcggtgggatttcatagtgcctgctgttccctagagcctctctgtatagagggtcagaatagatctgaggctgtggtctgggggaaggggctggtggtgcttaccatctctaggggtgggaggagagggatgaggatgcccctgagcagtgaagcctcaaggtgtgtggagccacagttgtctctcattagacatgtgttttgcgtgaggatgccagggcctggtggttattactgttgtcaagtttgcatgacaaggacccaggtatccagggatccagagcacagggcccctggtgaggggatgaggctcagatggggctgaccaggttcatgtggtcagagtgggagggactgatggagagacagagcctcaacccctcctgtcaggagctgtggctatgtccaggagagatgacaaggatgacccaggacattgagtgagtcattgagacattgaaggtgaggacagggcagagaggaccctggtgactgctgaaatgtaggatgtgaggagggctctgacccatgcaagttacaggacctccccacccccgagcccacagatgacccttaaattgggcatcctgagtgctgtgtgtgcccagcagggacactggataggctggacctgagtctctgtaagggcagcgctggtctgtaggaccagagtcttctctgtgggtgtgacgtgggcaggaattagcaagatgggggtgacaaggcttggcttggaggatctggtacagaagcccatgggcttggtcagctcagcttctcaggggctcagctggggctggaggagcaggatgctgtgctcagggcatgctccaggcagcgtgatgtgtgtggttccagggtcaggcacgggggtcaaaaattaaccatgaaaagttcccaccttctgtaggcagagaaaatggcctgattgtcagggtcagggagacttaccatgtggccaaagcaggctctcagcctcccagagaccacaccctgggtgcagcactcagctctgcagggtatggcaatagatgtgccaagaaccccaacatccagatgcatgcaaaaattttgcgatatataaaatagagcagatcaagtttccctgcaataacgttgttcctggttgtgtctttttcttgtaaactagacatggacatctttccagcagtctgttctcatctgccaccttcctgctgcagcacctcagaatgaacattcctgagacactgtccgtggtgctgacgaccaagagctatggaacagagtgtgatgtagaatcttctagttacctctgctctcctttcacttttaacaacagagcatcattaacaatgagaaggtggagaggtgttcaggatcttgaagtgacttctgtcttgctctcccataaccctgaagctgctgtagacattattgcagaaactgacaccacagtcaggatggccttgtccaggagcccatgtgcagtttgtagtgagcaaggatgagaaaatggtcttgaaaggggtgatggacagaacaggggcttttcaaaaatgtcacatcatcacccccagcatccgtgaatctgtcacatggtaagagaccttacagattaaatgaaggattatgagtttggaagattattgtagtttatccagatgggtccaacataatcacagaatcccttccttacaaatgagagagggaggtgggagagtcagagaaggaggaggagatgtggggatagatgcagaagacagagcggtgtcaagatgctgcactgctggctttgaagatggagaaagaggacacagccaaggatgcaggaggcctctaggaggtggaaaaggagaggaaacgcactctgccctggagcctccagaaagaacgcagccatgtgggcaccttggttcaagtttctgtgtcacttagcttgtgggaatttgtcacagcctcaacaggaacctacagaggagtcaccttgtgtgcaggtgggatccagggtcatttacagctaaatcctgatgtaaatattgcaggttgcttttcctacttcctatctcatggccaacaaccctggacaatggcagaacacccttggaaaccacggctctgtgctttagtggagggaccagcttgtttgtgggaaggtagcacctggtccaagtgaacctacatgagatcgttactctccccagggccctcagggaagggctgagaacagctggcccaggtgtgtggaggagctgcaggtgaggcagggctggaggggcctgtgggtccaggtagaggggcagacaggttgtcccatcgccatgggagcctgcacgagctttaggttggggaaccctgctcctctgacctggacgctcctgtgtggagaggaggcttgctcagtgagatccacgccagggggtaaattgggaactgatgggaaatgaggggctagagtcctgggtagtgcctgggaggaccttgctcaaggactgaattcttggtctgttcccaccttggttactctgacaacccctctctgtgtcccacggggataaagatctcctgagcagtggccattgggacagaggagaacctggtggccagagctaagcatccaggatcctggatttggggacaggcaagctcattgctgggggacagtgatagatacggcctccagggcctgggtgaagagagcaggagggctcaggacactggaggctgtgtggaggtcacacccacgatctgtaccacccatggatgctcctgcattgctcacctttgtgtggacatcagatggccccaacttttgcactcctgagacatctcatgcattcacagagggacccaggctggggctgtgcatggccttggtctctagggtagtgtgaggacagctgagcactcagctggctgggcaggactcctgcgaatcctgccctttcctgtgtagggtccaccccagcctgactcctaaccccctactcctgtctttccagggaagagagactggggttgagataaggtggagatatttttcctgtgtgacccaggagagaatggacatggagtttcaggtgagtttctgctaagttcccatgagcagaaaaagagccaatgagaggaagtttcccctttattcagatcctttccaggtgaccccgggtgggccataggcccattcactttccctgcaagcccccgcttcctgtggtgatgggaagccttcgccttggcccacccagagcccggggcagtctgttgaggtctctatatattcagcagggacccccatcccttcctgtccccaggcctgtgtctcctcaggactcagagctggttctctggctcaggctccatgtccttccccatccccagggctgggggcttcagggacgctccatcaacccacaggagcagctcccagaggaacctaagaagccacatctgctttgtggtcgatccagcagtaaatgtttgtgtcagagtgtagcaattccagtaaaaacagagaagaggtcttgacccctgaggccttctcagaacagggtctggcatctctctctgggcccacccagggctactctgggactgaacctggctgtgctcagggggttcctgctcccaggcccctccctcctctgctcaccacctcctgttattttcactgcagtttcctgaacttcagctcagccagatgccagtggggacagatcctgggtctccctggggcccaagggaccagaatatctgtggcccccactcacctcatagatgagagcagctgccctggtgctgggtaggggaatctgggcaggggagagaggggtgtcaggggacagggaaggattcctgctgtgtaggaattccagggctctcctcaggtgatggagggtcccagggtggggttagcacagggagtggatgatcctggccctgaacagaggcccagctcatggccagggcaggtctaaccttatccaagtcattctgggtagggtgggtttgtgctggggattgacagtccccctgccctgagcctgcacagctggggccccagtggaaatgggattgggaacggacagtcttacctaggagatggagctgtcagagggtccatggcctggggacagagacaaaagtgagcacgagagtgttaggatagctgggcccctcctgcaagagtgtgtgggggtcctcagttcttagagaattggggagagggagcctttctcaggttattttaggggtcaagtaagcaagtgaggttgaggaagtgacccatgacccagagcccggaggttagggctgacccggccagttggggtttcctgtgtgatgttttatgggatcctctttgcagccccagggatagggtcagaggcccctgggtgtaactggcaggagtggacaacttggggctggcttagtagttcccagccacacccagactgaagggacactcaccgggggtggaggctgggggctgctgctccctgaagtcactctgatcgctggccctaggaaaggtcagggttatttgtgaaggtgcaaggttaaaagtcacaaattggagttaaaataggggaccaggaaaggagcctatttccaagaggggtatggagacctcctttctttatggagttctgtggtaggaggggcccaggtgaggggagttgaggaaaggccttacaaagccacatctgtcctggccagaggggaaggactctcaggcagatgctgggccaggagaacattgatccagtgacacaggaaagggactgaggacccagggaaggaatcagaccaccaggggttgcctgagaggaagggtcaaggcaccagggggaaagcagggccaggcacatgtgcaggacactgaggggactgcatgcatcttggattctcctggaactcagtgtccctgctgtgaccagacactccactcagggctggagatgctgaaatgggacaatgatcttgtcttctgtctctgccctttggcaagagacataaacgacattccaggatatgccatattggggccccggttctcccttctcacagctcagtgtctgcagttaccatgtcagtcaaaggggtgctgaccccacccagcccgtccaggctgttccagtctccactatgtgataatgcccaggatcccccctcagatgccctctcactgggtggatggattcagtgaacagggggaggtaccaggtattgagcaccgctcccccctgctccaggcagctgtggctttgctgtgctaggaaactaggaccatgctcaggggcatggccttaattggactgaattcactgaggacaaagctgttgaggaagcagcccagggtcagcagctggtgaggaaggtgccatggaatgagagggaaggatccctggggagtcgggaggctggggagagcctggcactgaatacaagacagggtctccttccttctcgcctggggtcagcgtgaaggatgggagcagaatggggaaaagctgtggtacctgccagtttttcggaggagcaggaaacacacaagtgcagccaccagaagactcccaaccaggaccccgatcaggatgcctagagtgttgtcatctgctgaaagaagaaggcaaaggggatgaggtccaaatctgttccagggggaaccatgaggggccttgcagggcaggggcatggtcagggaggaaggaaatgccatggagcctgagtgtggtctgttgtgctgtcctcatagctggctcccttgctctccgtggttgcaccattttctgtgtcttaggcttgaattactgggatgcatcaactcctacattctcccacaggaagcctgcacctcatcctgctcctgtgttttttagtccctccttcctctcacatcactcctcttccccctgtttctttttttccatcccatggcagtcgtaaagggcaggcccttgctgccaactcaatgctgatgagcagggatgatgttcattgactgttttcaggggccttccacatggaaggcacagtgggaatcaatctacctgcagcttttctcaccctcccattgccttgagggagaagggtatgtgatattgtgaaatacgtatttggtgttcatcaccattgatatggttaggctctgtatccccacccaaatctcaccttgaattgtaataatccccatgtgttatgggagggaccttgtgggaggtaattgaatcatgagggtgggttttttccatcctgttcttgtgatagtgaataagtctcaggagatcagatggtttcataaagggaagcttccctacacatgtcctcttgcctgctgccatgtaagacatgcctttcaccttccatcatgattgtgagacctctccagccatgtggaattgtgaatcaattaaacctctttcttcatacattaccaagtctcaggtatgtcttcattagcagtgtgagaatggactaatacagtaaattggtaccagctagtggagtgctgctataaagatacctgaaaatgtggaagtgactttggaactgggtaacaggcagaggttggaacagtttggagggctcagaagaagacacaggaaaaaagtttgaaacttcctagagacttgttgaatggttttgattaaaacgctgatagtgatatggacaataaagtccaagctgaggtggtctcagacagagatgaggaacttcttgggaactggaacaaaggtgactcttgttatactctagaaaagagattggtggtattttgcccctgccctagagatctgcagaactttgaacttgagggaaatgatttagggcaactggtggaaaaaaaattctaagcagcaaagtgttcaagatgtgacttgggtactgttaaaaacactcagttttatgtatttacaaaggtatggtttggaattggaacttatgtttaaaagggaagcagagcataaaagtttggaaaatttgcagcctgatgatgcaatagaaaagaaaaatccattttctgaggagaaattcaagccagctgcagaaatgtgcataaacaatgaagagcaaaatgttaatccccaagacaatggcaaaaatgtctccagggcatgtcagagaccttcctggaagccccttccatcacaggactggaggcctaggaggaaaaaatgtttcctgggccaggcccagggctcccctgctgtgtgcggcctagagacttggtgccctgcatcccagccactccagccatggctaaagagggccaaggtacagctggggccatggcttcagagggtgcaagccccaaaccttggcagcttccatgtggtgttgagcctgcaggtgcacagaagtcaaggattgaggtttgggaaccttcgcctagatttcagaggatgtatgaaaatgcttggatgtccaggtgaaagtttgctgcagaagcagagccctcatggagaacctctgctagggaagtgttgaagggaaatgtggggttggaaccccgacacagagtccctactggggcactgcctaatggagctgtgagaagaagaccacaatcctccagaccccagaatggtagatccactaacagcttgcaccatgcacctagaaaagctgcagacactcaacgccagcctatgaaagcagccaggagtggggctgtaccctgcaaagccacaggggtggagcccaaggctatgggagttcagctcttgcatcagtgtgacctggatgtgagacatggatacaaaggagatcatttcagagcattaagatttggctgccctgctggattttgggcttgcatggggcctgtagcccctttgttttggccagtttctcccatttggaatgggtgtatttacccagtgcctgtacacccattatatctaggaagtaactaagcttgcttttgattttacaggcttataggtggaagggacttgccttgtctcagatgaaactttggacttggacttttgggttaatgctggaatgagttaagactttggggaactgttggaaggcatgattagttttgaaatgtgaggacatgagatttgggaggggtcgggtggaatgacatggtttggctcttcttcacccaaatatcaccttgaattttaataatccccacgtgttgggggaaggacccagtgggaggtaactgaatcatgggggtggattcttcccatgctgttctcatgatagtgaataagtctcacaagatctgatggttttagaaaggggagttcctctacacatgccctcttgcctgccgccatgtaagacatgccttttgccttctgccatgatttcaaggcctccccagctatgtggaactgtaagtcaattaaacctcatttttaaaaaaattacccagtctcaggtatgtctttatcagcagccaagaccagctcggtcgcggagatcctaacccagcagtgctagaggaattaaagacacacatagaaatatagaggtgtgaagtgggaaatcagggttctcacaggcttcagagctgagagccccaaacagagatttacccacatatttaataacagcaaaccagtcattagcattgtttctatagatattaaattaactaaaagtatcccttatgggaaaccaagggatgggccgaattaaaggaataggttgggctagttaactgcaacaggaacacgcccttaagatgcagattgctcatgctattgtttgtggcttaagaacgcctttaagcggttttccaccctgggtgggacaggtattccttgccctcattcctgtaaacccataaccttccagcttgggcattagggccattatgaacatgttacagtgctgcagagattttgtttatgaccagttttggggccagtttatggccagattttggggggcttgctcccaacagactaatacacccattttctggtatgtgactctaaagtccttagaatcttcaaagtgatgtctttttcaagctaataattgactgatgactggcagcccctaggcaacttcagaatgaggctggtcactgacccaggtaggattagagggttgggactttcagcctcacccctaatccctggggagggacctggagtttgaattaatcaccaatgaccaatgaatcaattaatggccaatgattgaatcaattaatggccaatgattaaatcaatcatatctatgtcatgaaccccaaaaggactgggtttgaagagctgaacccatggaagtttctggagtgtggtgcatctggggagggcatggaagctccacaccccttcccacatgccatgctctgtgcatctcttcatctgcatcctttgtaaagtcctttattacaaaccggtaagcctaagtatgtgtttccctgagtcctgagagctgtttgagcaaactaatccaacccaaacagggagtcatggaaacctcaatgtgaagccagtcataagaagctctggaggcccagacttgtgactggtgggaaggtggtggcaattttgtgggactgagccctctgctgatatgtccaggtagatagtgtcaggatggaattggaggacacctagctgatgtacggtgcagaactgattggctgctgggtgtgtgggagaaacccccccgcatcacatttggtcacagaagtgtgtctgtgttgatgattgttattgtggagtgagagcagaggaaaaacacagtttgagtttttccaaacagggtggaatcccatctgccaatttagaatctgaaacttatagtttcagtacttcaattaagattgaagtacttcaattcagtacttcaattaagattcagtacttcaattaagattcagtacttcaattaagattacagaactggtaagtgaaagtgatacaacaaaaatgtaaccaaagtctgctcaacttaacagctaataacaacaaagttcataaaaataataccagtcgatattgatagcactgattgagccctggctctgtgcatgaccttgttaagggctttaatcgcattaatctctgaataaatatcctcacaaccaccctgagatccaggtgtttgtaacaattctacagatgaggaaactgaggcccaggaggttgagtgtcttgcccaaggtcaaatacctggtacctattgtaaccaggatgataactggatgagtctaatccctgagttcttacccacattgctccccaggctctgaaggaatctcatccttctcattccgtgtatcattttacaccccccctccctcctaggaaaatatacaaggaaaggagtgagaggggccgagggtcactcacattttacagtcagcttgagggggtcgctcctgttggagctgactgggttggagacctcacactgatactccccagcgtcctcctgcctgatggggtctatggtgagcatatggttaaaccaggacagcttcatcctcttcgtgacctgcagacgctggttgttgaaaatccactggaaagaggttccagtgttatttgtgtggcaggtcaggaccacggagcccttctctgtgactgtggtgctgctggcttggatggagggctgagccactgactctgtggatagagtgaccaacagaaagtgtcttggggccatgctgcatcctcagagatctcagagtcaaatttagaacattctcctgtgaataaaggagaaagatgaaggacagggaggagcagagagaaccagagacacccatagcagcgagcagtagggactacagtgacctcagagaccccagggaccaggaggacccagctgcctcagaccaggaccagggagccctgaaaaccctcccacagatgagcggccccagagtcacatgagatgcaatacctggggtggctttaggagcaggcagtcagagaaatggaacatgggtctcagcccctaagggacaaggaagaggtgtggccagctcctcctaggatcctacatccaggacccagtctgtaaagaggttatgattattcctttcttttttcattaattccctccctccttcatcagagaactactgagtgtgtgtctcagttgggccttgtgcaggtacagggtgtagtgggaagagaaagctgagtcctttccttcatcctcccatgggagtgacatcaacaaatcaagaaattcatgatttcacgtccagtgagggaagaaatgtggatctgatgggagaggcttggacaatcctggcattgagtctgatagttgagacaggtgatttcgttctaagtaaaaactgactaattctccatttgcccgtcattcctcagaccagaatctccctctctgagctgaggatgcccaagaagaaaggagctgaaccaacatctggtcctggggtccacagatgccccacggtggtggccacgaccagattctgggctgcagacacacggtggtgtgacgttgagcactgacagcctgtgtgatgctgatgcaatttctctttaataaaatggggtaaatgtcaatggtccctggcttgccatcctctctgtaaattaacattaaaatatttacaattacctgacctaaagcttggcacagaatagctccaaataaacatcatctattattattttactccaaaaaaaaaaaaaaaagagttctctgggcctgattcctggtggagaaggagcggtccagagtgtcttttctctgctttccctcctcctgaggacagtgcacttcccgggacatcttttaagtttcccatccagtttaatggcctgggaagtttgtttgtctgtcctctccactctgactctcaggtgaaagatgaggctctgcccttgcccagatggggctctgggggctgagccctgcctggtgaccagctctaggaaccacggccctgggacagctggtaaatcgttgctcacaatcagccctgcccaggaagccacaacccagccctggcacaggctccccagggtcatctggagtcaggatcttgggacaggggcctggggcaggggcttgaagggctgagcttctctcagaggatcctcaggccaggccctgactgagtcctataagatctttctcaggtcatgtctatgaggaggaggccaagcggggttggactgagactgattttcccccgctgcatctcccgcatcagactatccttcttgctgtagggaatttccacggagtccggataagggaaaggaattctgatctgttatagtttgtctcccctgggtgtgtcctgcactaaatgcccaaaccccaacatgggacgtaatgcagagggggatgcaggcacagcccaggcctgacaatcctgcgtatgtgaagcagaactgacccccaacacccagaggcacggaggaatcactcaccgtatacacggagatggtgagatgcctgttcaatctgagaatttctgtatgtgacttgtagggtgtagtatcccgtgtcctctagggtgacgttctggaaatgcagatctccactgggtgatattgtctctcgaccgctgtatgcaggccctggagtcctaacgtgagtgtctattacatatgctgcgattagctggttgggctccaccgttttccctttgtaccagccatagctgtaaagattctcgggcagataaaccacagagagatgaacattctccccttcagcaacttcaaagggcgctgatgcaataaagagccaggcagtggtgggtgcgttccagaaagttaaaagtgaggctaggaaagggagagaatatcagtcaatatttgacctatgcattggcatggaaagacggggtcctgggtgcaggtctcttcacccctcagccttagagggtgtgtgtgtgtgtgtgtgtcctactgggtcaaagtcagcagcatgaccctcattccttcagtacctctgaccttggcatttccttgtgtgaaccctctttcccaggggtctgcatggttccctccccactgccttcagttcctactcacacaagggaatccctgggagacttctttcgtgaagcctcctctagagaccctgggtcttccctttctgacctttcccagctctgttccctccagggctcttgtcagcacctgacctcacattctagatctctttgggtgtctgtcttcccccccatgagattgtgagctctgtgagggcatggacttgagtgatgttagttgcaccccagtgcctgggacaggctgcagactcctgtggatgagttcatgagcgttcccagggccttccatatcctggggtttatttgctaatgtctgaggttggcagatgaagacagagtttcatgccctggtggtgtttttatttaaattgtcactgtgatatagttttactatcattttcaaaatgtagtggccactgacaatgaacttgaaaacatggaccaactgagattgttttgccccttggcaattccagttcacttagattttttggttctccttagacgctctctcccctgagtctctaacaaaagccctctgtctcctctcagagccccatcctccccaggagaccccagccagtctctgtgctccctcctcccacccactcccagggagtcctcccctcacctgtgagcaagagcccctgccaggggatgcattctctgtggggacaagctgaggggggccccatggtctctgctgcctgctctgtcctcctctgtggagaggagcttgggctccaggaacgctctagacagggttactgtgactgttgtctctgctgtccttccttcctctatgctgagcttcctctcaggcaggagcacttcccgtttatgggcaagggcggggctctgcctacaatgtctctctgtcccctcccctctcagtcctgcctcccttgtccctcctttctccttcctttttgcctatatttggttccctaggcaaaactttgagaagcaacgctgatggggtcctcataacaggacgacccactctccccagtactgacctctgctgtgttctggccttggttctgtcacagccggtagattatttccctttgtgacacacaaaaccagctgggccctgggtctcctcatgctctccagtgctccaggaaggcagaatgatgcccagcaggaaagtgacagaggtggctctgggggctagaaaggggctcactgggtgatggctgggaaggacccacccgctatcttcagtgtcaccagcctggcctctgacccagggacagagacccaggcctggaggtctcgggaggatccccagctcctaggtgtggagggaggtgtcctgtgtgtcctgggaagagaggactttgatggaaggaggtgggaggctctgggttctgctgtccttggtgaaggtttcagggggaccctctccatgtctggggtctgtgcccccagcttaactctcattctctttgcaaatacatatattttgtggatctgcagttgcctgaactgtctcatgtccctaaatctttgtatccctttttacagaaggtcaggaagggtgtgtacatgagtatgaggactatctgatcagggcgagtgtttgtttcccaaagatctctttagatatggtataatacataagataaatgtactgaattagcaattttaagtgtagaattaaatgatactaattctattcacaatgttgtacaaccatcaccataattttttaccagaaaatcttcattataccaaatggaaacttcatacttttaatcaataactccccacttccccctgccccacccactggtagcctctgatactatcaatctctgtgaatttgcctagtttacatgtctcatataataaggaattatatacgtgtattatttttttctggattatttctcttagggtaacacttttaagattcatccacgtcgtagcatatattacagcttctttcctatttatggctgagtaatatcccaatatatgtttatacctcaattttaattcattcatctcttaatggacatgtgggtggtttccacatttttgctattgtgaaaaccgctgcaatgaacttacacttggaagtatctgtttgggtttctgtgttcatttctttgggggtacatataggagtataaatatggggtcatgtggtagttctatgtttaagtttttgagaaacagccaaactgttttccagtttgctgtgctattttatattcccatcagcaatatacgagggttccattttctctacattcttgtaaacacttactatttaatattttttaaaacttatagccattctagtaggtgtgaagtgatagctcattgcagttttgattttcatttccctggtggctgatgaagttgagcattttttcatgtatttactgacaattttaatattttttagagaactatttattcaaatcatttgctgtttaaaaaaaatgggttatctttttattattcagttgtaatagttctttatatattttagatacaagtcccttatggggtacatgatttgcaaaatttttctcatattctgtgtcttctcactttcttcatggtgttctttgaagcacaaacatttttaactttgatgaagttcacttatctatttttaattttgttacttatgctcttgatgtcatattgaagaaaccattgcccaatccaagatcattaagttttactcctatatgttcttctaatggtttgataagttttgctattccatttaggtttttgaaacattttgagttaacttttgtatgggctgtgaggtaggggtctaactacactatctcgcatgtggttatccagttgttccagcacaatatgaagaggctaccattctttccccattgaggaatcttggcacccatgtcaaaaaccaatgggctgtaatggtgagggtttatttctggactcttgattctattccattgatctctatgtgcattcttgtgccagaagcacactgttttaatgattgtagtgttttagtaagttttcaaattaggaagtgagtcctccaatttttttttccagattgttttggccattctggggtgacttttaaaaaagatgtagttcaatggttctcaaagcaggagtggttcagctctccttttttggcagtctggagacctttttaggaccttaatctaagtagataaattattcccactttcttttctgagttgctatgttacagtgtatattgacacccatgaaataattgagagaccctggaagtgcttgcctacatagtgagggacaattagttccatgatcatgggcacagaagattttgttttgggaaacaattttgttggtggagttatattcatgcttactcttttatttgtcttcatagcctgcatctccttcagacttcatatctgtttattttcttgtttgtcctctggggtttgggtgttgggtgaccagtcagctggagctggaggaggtgcttagcaaggcagtgaccctggttgggaggagcagggctcagcagggtgaaagtagctgggccttgagtcaggagtggcatctggaaggcctgactgtaagggtcagaagggccagcaggtgggtgtcctaggcacaaacggtggctgctgctgtggactggaggaaggtaagaggccccgagtattccatgttcttactggctccccaactgaggattcctctcctgggctggtgctgtcctgcagcagggaggggttagacagggacggctgcacatcaggccggagtccatgtcatcctcttaggcactgtcactacagattgaggattctgttcataagccaagcctttgcacaaggaagggacccgggctctcaaggaagagcagctcctggtcagacctccatctccttctctctcattgcctgaggcctcaagcttggtctacctggcacaggggtctggatcctcctcccagggttggggtcttactgagctgggcacctgcaggtgggagaagatctggaggggccccatctgccttcaccagattgatgttgagggtccctgagtcctgcaccactatcaggtgctgagcaacttccagtgtcagtgacaaccaccccatggtggaagcagaaccacctcgtgagaaagcacctccaagcctcagtgcttgccatgtgtgggaatttgctggtttcagttgggggcatgttggtgggtggtcatgaattcagggccggattctatgctcacagtgcacatgctggatgtggtacagaccccaggcagggctcagtggggtggttttgggtgtgcacaggtatcttttctggaggagctggtggtgatttggctcccagaagttcctgagctctgcagactcaccaagcactcaatatttgagtgaacattgggcgagagagcagaaggtaagtgtcagggcatcggggttggtgcctctgggaagaggaggaacattctgggaacaaagctctcccccggcttacagggagcttcccatcgctcctgccttgaggatcagggaaactagggcctctgctcttccaggggctgcttgcaggcagtttgctctgggagggggtgacccaggagttgcctctcattttgcatttgagatttaaaaggagaagggacagtatatcttgccaggtcacaaaaattacaggcatcatattgactgaagggcactcctgtcatcactgcaatataccagaatggtcttttaaaaaaataagtgatttaggtttaccagcaactgtaatgcttgttttattcttctagttcaccgttaatgtcacttttgtagttttagcactggcaatgttgattttatgttgactctgatgattttaagctttcatttgttcacatagagatcatcttctttctgaatattaatgcattttttctctatttctactggttattcctgtacatagagtagagaatcacttttcccaaggaggtggaaagcttctgactaccaaaaaaaaaaaaaagtgtcaaaatgctttaaagtcagtaacttaaagatcaaatccaagagtgggcaacagattctgcccagggtctgaaaggtggagaggtgactggtgaggatgtttaaaagacctctcctctctactccctaaatgggggccatccagtgttcttgaggttcagagaaggcccagggctggggcagcagggcactgtcagctcccagctcccaggggccaggagtaagaccccaacactgtccagacactgattgcattcattttgggggagagtagattcttatttaaagaataatacaaaagtctacaaatatgaacataaacagaaattcctttgctacaattttccccttaataagacattccttcctaatgacatatgtgactgcattcatggctgagatgttttctaggatggtgagagcatcagagtggactatctggtgccttggggtcatgcattttcttcttccaatgtctacaggatcccccatgtcccactttgtagtgtaactcagtgtgtgtcattctggtttttgttgtatagatccttggaaagcccatgtcattcctgctgtgaggtacaggcagccaaatggcatcatctctaaacatgccttctcctggtacatcaaattatggaataaatgaaagccattttgacagatattgaagatataagtttctactcttcccacacatgcttctcccaagtgaaggattttactggtgaattgttattagagattagtgtggatcagtgactctgccaggggaaattttgccctctaggggacatttggcaaagtctggaaacattgttggttgtcagagctgggggagggagtcctgctggcattgagtgggtggatggtgctgaacaccctgcagttcacagagccccaccagtttgaccacccaaatgtcaatgctgaggagtggagagccctgctgtgccctcccgcagcttccctgaagcttcccctcacctgctcctcccatgtctccccaccacttccccacttcacccgcctccttacacctcagtcccctccacctgaactcaccccttagtccaaggccagccctgatctccgctctcctggtctccttgctccttagcaggaggcgcccactagatggcgcccttgcccttactggagctcaccgtctccctttccaccctgagacaaatgtggctgcttttactgccacaaccccagccctccacactctagatttgctcagggagcagctcctggacagacctcagggaccccagggaggagcctcactctggagattttgatggcatggtctttgaacttcactgttacccccagtcaggatccaggatgttgggagtgcatgattctgcccggtcccacttcagcaggaccccactgctgagttgtctgtggggacccgggcctctcatctccttcttgcattgcaggagagggatcttagcactgctttcacataaagtcagataatggaggagtgcaggtgagtttgggaaggtggacatgaagagaggttgtgtccctagaggtggcagcagtgagaggatgggcaggtgggaggaacacagcccatccagggttgccagccatattaggagcgacagcctttcctctaagcctccagcctttttcctgaaacattccagaactttccacttcagcacttcccactgaggctcctcaggtctgtccctgagctcccagctgagcctacctacccatctgaaatcctgagtcctgtgtcaccctcgttccccattattctgtgcagttctgtgggacgcccagctctcctgacacccccagtcttcagaatggccatcagcgctgtcgctgtggcaccagggtgactgccgcctggaggctgagtcctggcttcctgacagctgtggggcccgctctaggctcccttgtcctgatcattcatcacctccaggatgcacagcagctgggccagggggaggagcagggacaggtgtcagccaccctgtgtgtctgcaagtcaggctgggggtgtgggaggacgccaggaatgactgaactttctgatttagagggtgagagcttgcactgatggaatttgggatttaataggaaaagcatagcgttttcctattttgtaggcagggtggctggagtttggaatcatagattcccctgggatgtcactgtggacctcagtcccacccgttaggggcacagatttcagaatccacaccctggggcaaagcaggcatgggaggctccatcagcctggccagggctctctatttgtgcagctgctgcaaggagatgtgcactctgatgggaacagtgctccctcctccttggggggcagtatctagctccctgcagcccctctccctgcaggccctgccctctctgaacctcaccttccccaacccgccccccgcaatcccatctcagctgtaatcccaacactttctcatccattatgggtggactgcttgagcccaggggttcaagactatgctggctggacaatatagcgagttgttgtctctacaaaaagacaaaaattagctgtgcatggtggcatacacctgtagtcccagtcactcaggaggctgaggtgggaggattgcttgagctggggaggctgagttggcagtgagttgagattgtgccactgtatacttcagtgtaggtaacagagcgagaccctgtctcaaaaaataaaagtaaaaaaaaaaaaagaaatatggaatacattattgttaactctaatcaaccatgctatgcaatagtccaccagtaataccagtaatagccaataatgaattatctgaaaaagaatacaatttattcttagctatctactgctaaaatttttaagctatcttttatgatagctgaaacaaaagaagtaaatttaaccaaggaagtaaaagacctttataatgaaaactgtaaaacattgatgaaataaattgaaaaagacacacgcacaaatagaagatattccatgttcatgaattggaagaactgatattgctaaaatgtccttaccacccaaagtggtctacagattcaatgcaatttctgtcaaaacaccaatgatattcttcgaagaagtagaagatcctaaaattagaaaccacaaaaattcctaaaacctgcacaaaacaccctgagttgccaaagcaatcttaaacaaatagaacaaagctagtggcattacacttcctgacaatcaaagcatactgcaaagctatagtaaccaaatcagcatggtcctggcataaaaacaagcacatagatcaatgaaacagaataaaaatcccagaaataaacccatgcatctctagctaactgattttcagccaaggagccacatgcacacaatggggaaaggacagcctcttcaataagtggtgctggggaattggatattcatatgcagaagaatgaacctagaccctatccctcaccatgcacaaaaaattaactcaaaatgtattaaataaagacttaaatgtaagaactgaaactatgaaactactagaagaaaatatagggggaaaatccatgacattggtctaggcaaagagtttttggataaaatctcaacagcataagcaacaaaaccaaatataaacaaacgggatttcatcaaactaaaaagcttttatacagcaaagaaaaaaaaggccagcagagcaaagagacaacctacaaatgggaggagaatatatttgtaaatatatacatatatatttgtaaatatatacatctgataagaagataatatccaaaatatataagaaaattatgtttctgtatagttttatctgactgggatacagaggccacatccacagtcccatcctcaaaggccacttgttcccaaaatgtcaagcacatccctcaatgatccatcatcaacacctatgtctgtaggatgaagggtgaatcatgaagcactaaaaaggaagaaggaagccaatcccaaaacaaaatgatgcagggtctggaaagtccaaagcattttttttttttttttactgcatcttcctcctttcttctccacattcccaatcctcactattgattaacaaaacaaaaaaaactgggacccaccatcttccctactgtcaggagatctagcgagattgtttgagtcttagaccaaactttgccataagccaaatttctggctgactttacaatgatatgagctagcacagtctctttttctgccagtcaacttgtgctcggttttatttgcaaccaaatagaggtggtaaccaaatataggtgaccctaaaattagtcatcaggatgaaatcctaaaatgtgcaacaaactgggttgaattcaggattagtagcaacatctctgttgtgggcttgaaaagggggcacccttttatgcagtagcaaaattgctaaattgttgtttgctgagtctttggactctcatcccggattttctatgaccattcaaacagggctgcaatgaacatctatggttgtttagcttggcacacttctacatttctatatagtaatatctagaagtgcatttgctcaatcacaagatatgcacattttataattgactgctatcgaactaccttaaatagccttaatttgttctcaacattgtttaacagggtctgtttaatgtcctacgtccagcaaggacagtatcacttttcttaatatttttcaaattattggaccttaacaaatacttaatgtgcaattaattgattcctttgtattcccatgccttcttttatatgtttccttatagtacacaaaaccacattattgtttctttacttgtgtcattccaccctggaccattcctatctaaactataacattatgagagagagagagagagaaaacaatatgaaaatataaattgattaatcaaaaaaatttaaataggacaaatcaggaagacacaagagagattttaaaattattcagagaataccacaatagctgtaccaatatattttaaaacttagatgaaacggacaactatctcgataaatgtaaattaccaaaactgactcatgaaaaaatggatattatgaatagagcaataatcagtaaagcaattaaaaagacagttgataatttttatttactgacaacaataacaaaatttcaggtcctgatatttttatggtgaattttaacaaattttcaagctcctcctcaaccaattctcagaaggtttaaaactttaacaagaaaacactttctaacacattttcagaagctgttatagcatgataccaaaaccacacaagaaaattatagaccaatctcacttacaaatatacatgcaaaatcaaacaaaatcttagtgaaccaaattcagaattaataatagcaaacaagcaaaatatgttatcatacgtatggcttatatcaggaatgcaagtatgtttcaacatcagaaaatacttctccacattaacagactaaaggagaaaaacgcttgtttaattatctcaataggtttttagagaattttgaaaattttataaagttatgcgtattctgtaaaattgatgaaatccaaccttgatttatttttaaaaattgcctttcctatagaattataggtaaaggaaacacatgcatcctcacagagctacttcaaggctaagttacttcccataagtaacgtatcctgtaatgtgtgcttggcacatattcaatactaaacaaatatttgcaaatcctcaaaccacttctcgctcaaataacccacctttgtcttttgcctttatgttagggttgattttctcaattgtatcttggagatcctttggtgggtctttcagcaattaccctgaatttgcttttctgtttacaattttaattcctgggaactctttcttgttctctgactgcacccttttcatgagagttcagccatcaatcctccagaaccccaccccccccgcccccccaaaaagcaataaagatgtctaaaagcttccttctgggctttcgaatgatgtttaccccaggcatttgttctattcgttcatcacccattttccctacaacttgcctacacttgatatcagatttttatttattagtcacctatcttcttcattggcccattttcctattttgccactggttgttctcaaatgtgttatgattcctggttgtacagtcaagtggttgataatcttggatatacgataaagatttgctctgtagctgtgtgtaagcctatataaaagcttttgtatttttcttcttaaaaaagacaaaagatggttgggaagatccctccagttcaccagttcgaggctgcagtgagctatgatagcgccgctgctctagcctgtctgtctgtgaaaaacaaggggggcggggggcgggggggaagactggagatgtaaatctcccgcagggccctacccgtatccgcaacaggtctctaacaggaacagcctcaggcctgtgttggaacaaggtaggttacagaaatctggaagccagatctgtaacttcagggtaaggactggctctcagggctgatcccccgggctgggtgtcccagaggcacccgcccccgccccttccccaaggcaggccaggacaccttcactcctctccttaggctccccacccccttctcctccccactgtgcctcctggagtagcggtggcggtgccacaggggagcggggcggggcgggctctgagggcaagggggatgggccccgccggggtcactggcggccaccctggaaactcgacgcaggccggcccttctagtgaatcgtcccagccacagctggcctcccagccgcgcttggggcgcctcggggcgcgaatggtgcaggttggggagactcaccacgcaccgtcgggggtcggtccggttattcctcaccgctcggctccagtgggcgcgcgggcctctcctcctcagttcctgcgctgcagtccctccctcacccttcgcagcttgggaatccaactgtgtcattccgacggagcgccgtgaggacctccgagggtgttagcgccaagtgatctctgtccagcgctctgaatatccaagtaaaggagttcaatgaagggcgggtcaacggaggagaaaccgtgactctctcaagggagcccaaggcctccttgtctaattagtgacgcgccaatggatggaggctcttcccaccatctcttcccagcatccagtgacaccaccgccaagggacgggctcggcggaacctgcaggaaagaagcatcggctgagcctgactgcagcgctgtgaagagacaggggaggggatcagtagttggtcccgcgcccaccccctgtttccgcgaggggcggagttgactggccatgcaggcagagggcgaaatgtgaaattccactactcctaccgtttttccctgacccgatggggcggagtgtcgtcaggctaagttccctggcggtaaggtggggagattgaggcgcacacctgccgaacggtaacgcaggattagctaaggcgagctcaggacagaagcctcccgaggagcaggagggcaaaataataaataaataaataaataataaataactcactccttggtctttatttgcggcaggaattcagaaggtgaaagcggggccttaggatctttctgaccttttgggttttaagcaggaggtgtcagaaatgttaccacagggctagctggcttgtggccagcaagcgttcacaatgccctcgatttttcatccctctctgtgggttctttttttcattgtaaggcagaatttctacgattgctcacccactcagagaacctgagctggtttagaccaggtgagacaggctaggtttaccctggtgatgatgtgttgttgccatggcgatcctgcccagtaccagaggccctgcagattcagatgcttggtgcctgtgcttggctgaggggccaatgggtgaagctgccatctgcgggatgatgactgaagcctctaagtcagaatccgcccaggctgagccttagggcagctccatggagcctcggctggcctgggatagagagtccaccactgtgccagcccccagccactgcctaggtcctgtgctgagagccccttgtccagggaaatggcgtccagtggaaaagggaccacccccttgcccttcactcaaggcaggttggtgacaaccctgaagctaatccgttcctagaggagctgcttctgggtccgagttttctctgcagcagagcagctccctggatgggatctgttcaaagtccgcctttcacgcggaattttccgtccttgcaattttccacctccaccactaggggatcctctctgaccgcctcatgccggctctggcctctgagcaggggtttctcttctgcatgtgcgaccttgcgcatgcctagtggccttttgggacctagagctgctccacaccccgatggggttacagagtgcctcgcctccactccaccccaccagggttccttccctggctgggatgggatttcagaagcgccgaggaacagcccagacaggtgtgggagagtagccaaggcccctgtcccggggtggccaggacagcggtggcctcgcataggacctggctgggctgctgcaatcagtgtcctgccccttggagagcaacagtgaaaacaacaagactatcttcacccaccttaagaaagaacagaaccagtatccccaactctgctgtgtatcccaacccaattccattccccaccccactctcagtagccaatatgcaaaatattagaatactcttactgttattattttcaaccacactctgcatcctgaaaaaccatatatttcgttatgtgcttttaaacttcttgaaaatgaaatactgaggctgggcgcagtggctgacacctgtaatcccagcacttcgggaggcggaggcaggcggatcacgaggtcaggagatcgagaccatcctggctaacacagtgaaaccccatctctactaaaaatacaaaaaattagccgggcgtggtggcgggcgcctgtagtcccagctacttgggaggctgaggcaggagaacggcgtgaacccgggaggtggagcttgcactgagccgagatcgcgccactgcactccagcctgggcgacagcgccagactctgtctccaaaaaaaaaaagaaaaaagaaatactgaattttcaaatacttgctttttttttcggtcaaaattatgttctcaaatttcactcctgtagatgtgcgtggctggctgtagtttttgcatttttattattaggtattctcctgttgcattaatatgccacattttatttctctcatgtttttggtgaccacttggggtgttttttggttttgtatttttgctgtatacatgctgccatggtggacatacctctttatacatatttcctgttgtatgcagacacaattttaggatgtgacatcttcagcttttctattgtgtcgtgtgtcttttccttcgtgctttgtgttatttacatattctggacacagattctttgtcaactgtatgtgctgcacatctctttcccagtttgtgtcttcttcttcttttttttttcttaaaaaaaactttctttatagtgttttttttttctttctttctttgttttgttttgtttttttgagatggagtcttgctctgtcacctaggctgaagtgcactggccgatctcggctcactgcaacctccgtctcctgggttcaagtgattctcctgcctcagcttcccaagtagctgggattacaggtgcctgtcaccacacccagctaatttttgtatttttagtacagatggggtttcaccatgtttgtcaggctggtctcgaactcctgacctcaggtgatccaccctctttggcctcccaaagtgttgggattacaggcgtgagccacagcacctggcctgtgttctttcttaagtagatgttacttttaatataatagaatgtatcatattttgcttttatattagtactttttctatctaattcaaacacatccccaagggtctttgtgtgtagactgaccaatttctcaagaatcatgaatgaatactgcttctctttccccaatttatctgtaatgctacctttattataaagtttctatgcatgtgtagaaatagttcctgatttttcactctgtgccaccagcataccaatagcacgctgtcttaaatattaaatagcagagctttatgagacaacttgatgtgcagtaggcaattgcccccttgttactcttcttcagggttctttgttgtaccacatgaattttagaattggcttgtccagctaaaagacaactgcaaggattttatttggaagttcataattctatacataatttggggaaagtattttcataataccaagtcttcctattaatgaacacagactctctctctctctcccccacccccacctgtttagttatttatatctttatggtctgttagttattgtttattgtctttcaaccaggtttcatgtttttctacatagaggccttgcatgtgaaagtctttcttcctagcttgctattacaaattttttttaattgcactttttgggtacagtggcttgtactgtaatccccgatacctgggaggctgaggcagatggattgcttgagtccagaagttcaagaccagcctgggcaacataatgaggtccctgtctcaaaaagtttgttttaaaaattgcatttgctgttattcaacaaatgtcattgtgtctcatatatggatttttatatctgataaccttgttcaacaatcttttgattctaacaatatatcagattcttttgagttttccatatagacaataatgtcatctgtaaattataattgtttcttctttgttatttcttggaccttttattttatatttttgtcttgctgcaaggcaatatccctctatatattgtggggtcttttttctcataaagtggggatggtgaacacccttgtcttgctctctgattgtataaagcatgctttctgtagcattttgtagacgctcttttttagattgaggtaattcacttttatttctggtttactgagtttttagcataaattcaggctgaatttgagctaaagctttttctggagacatcatttgaaaaattcatatgatttactttctttaagtcaccaaagttatgatttacattgaactgagtttctactgtttaactgtattcttgggagaaaacccacttgtcactgaacaatatctgttttatttactgctgtcttgtgtctaaattttcttttaggattttttgtatatgctcagattagcctgttattctcctttctgtatttttttctggtttgggggtcaaagttataatagcctcacaataagagctaagaaaccagccctaatggaggccggggcaggaggtttggagttcaagaccagtctgggcaaaatagtgagacccccatctctatgaaaaatagaaattagccaggcatggcagtgagtacctgtagtcctaggtacttgggagggtgaggcaggaggattgcttgagcctaggaatttgaggctgcagcgaactatgattgtgccactgtactccagcctggatgacagagcgagaccctgtctcaaaagaaaaaaaaagaagaaataaaaaggaaaagataaaagagctaagcatctgtttccttttttccattttctgggagagtatgtgtaagactgtaattaactgtttcttgaataatgggagaactctgtaaaataatctggctttggtgttacctgtattggaaggatgaaaaataccaattcagtttcattattggttgatagggctactcatgctttttgttttgttttgttttgttttgtttttgagaggaagtctctctgtattgccctgttgtccaggctgagatgcaacgttgttcacaggcctgatcctggctcactacagcttctaacttccgatctcaatagatcctcccgcctcagccttcccagtagctaggactacaagcatgcagcatcacatccagcctcttttcctgcctgacccagttctggtttcctttagttttctaggtgttcatccattttatctaatgtttaatgcatttggcataagggtgctcagtgtcctttcattgtctgttgtctgtaactgttgccattttcattcctatttatgagtactggcgtcttctctcactttttcttaataatcctgctggaactttgctttttaaagaacatcttttgacttgttgattcttttttcatacatattaactattttcttattttttgcctttatatttatttcttttcctgtttgaaacattgctcttttcttactataaaaatgggtaagtagctcatgaattaccacctcttttaaaaatcttttctactgtaagcattttagcagtttacatttgcccacaagtaccacttcagctacaccctatgtgcttttacataaagtcttcatttttggtaagacatattctcaaattttaattatcacttgtttttaaatccatgatgttttatttgaaatgttgtttctaaagatacattttctggttatacttttattcttctaatttagcacagtggccacaaaacatggtctgtgcagtgcatacaatcgatgagtaatttctgagctgtagtatttggcataatatatggcaaaatttcctaagttttccatgtgtgctttaaaaaacttccagtaaaatacataaatctgttagatcaagcttctcacattgttcaaatagtctatatgtttactgattcatttgactgcttgatttatcaattacaggtaggaatgtattcaaatctcctattaaagtgtgacactcaagtggctttttaaagacagagatgccaaaccaatgaatacatgattttccccaaagcctgcacaaattctctaatgaaattttaccatgaaagtttgtttaattaaggcttactaaagcagtatgttgtcttttactttttaaacagagaatatatattttaatacatcgtttaagtttatgattaattatctattactgaggataagaatctttgcctgtgctcattcagcatttgcacttcatttatgatctgccttctcatagcttctgttaatttttatactagagacatttatttgtttgtataaatgttgaaggtttttttttgttgttgttgtttttgagtcagagcctcgctctgtcacccaggctggagtgcagtggcatgatctcggctcactgcagcctccatctcctgggttaaagtgattctcctgcctcagcctccagagtagctgggactacaggcatgtgccaccaagcaaggctaatattttgtatttttagtagagatggggtttcgtcctgttagccagggtggtctcgatctcctgacctcatgatctacctgcctcggcctcccaaagtgctaggattacaggtgtgagccaccgtgcccagctgggttttttatattataaggagatgtaatagatagatagatgtttcaaagatagtcaaatgtttttaaaatttaaaacacttttttacaggttgactttcaccatttaatttcatctatgtgttttgccttagagaaattttaaatgctatgtagatctcatgacttataattatgaagcattttgttttctgttttccacgaaacttagcttaactttgagcatataatagttgtaaaggtaggagagtaacactgaaaaaaggaattgcataaaaatggcacattttctgtagagttgtttatcgcctgaaaataggccccatttcatggaagtaagatgatcaggctcaggtccccagacgaaactcttggcatggtttttggagatagtccagggctcagtactggctctatcatttgctacttctcccaaagtaaccaatatctcatccaccctgagcccatttccatatctctaacatgaggataatagcatctaccttacacaccaagtagagggatcaaatgtaggaactaaatcaaagtaccagcactgaataacctacatcctcccacttcccaaaaggaagagagatgtatcccctgttgacaaacgagaccattttgcaggagagaaaggaaatgccagttcacttgcaatgtaaacatgctctctctttttagggatgtccagggacctgagagagaacccatgcttaccaaagagtttctagttccagacacacaggactcgaagggtgacaagtatggttttcagggtccctgaatccacccagtcctcacagaaactcctaaaagctgtcgattgacagcgttgagttcacagctctggtcctcacatgctgatactgcttgtgatatcgaacccgacaggaccccacatcacaattgatttaccaactacaatataatacctcctgaatctccaaattggctcacccaggaacaaaggcttggggtaaaactggattaggagatataagctctgaattttctgagggtgagacacacaaggattctaagtgacacgccacagagtaacgggtctgtgactggaggacccacagatttgtcttactggagacaccacatgcacacaaactccatccttagctgtggaaacaagggtcttttgctatcttagccgaattctgggagtaatttttggaggggaggagatctttgggattgcctctttcaggccctttacaaaaatacctacttcttaaatggtaaagcttacactaaactgaaaaaattacatccttggctttttatgaagtaggtgttggattgaatcactactggaagaagtatggcatcgcaaattctaagcagtggtcaaaggatggatctgttaaattagaaaaatctctaaatttataaaaagattttagattcctttattctaaacaattgacctatttgtactcatgggacaatcaaatttcaaaggagatatgtaacgatttcatggcttgcattaaaaatccttctgataaaattaaagataaaaaatctgaccccctgccaaaaaaatcttttgaagttcatactgcctgctttcaatattctgtgggattcacaatgaaaggtgccttatattgtggcctagcttcaagtttatgccttcgccaccatggcctgggttcaattcccagtcagggccccagcgcctttggtttaatgtttgcgtggcatttgacttttttacctatttagtattggtgagattacctttggtaaaaaaaagtttaaagagtggaaatcgcaattctttgtgttggctaaaatctgattataagagatctggaaggttttatttttctttttcaaagagctctatggtcagaagtcggcttcatgaaaagctaatatttaattatatgtacatacagtctttctggattttctcttttgcctcctgttttgaaaaatatttggatttgagtgaaactccgttttagaaattaattgcttggtacaatatacccatgtaactaccctgcacatgtaccccctgaatctataataagagttgaaattttgacaaaataaaattagattttgaattaaaacaaataggtgcttggttcctctgctcacttctttttaaaaggaattcctctcccatgtacttcttcttttcccttctttaccttccttttggcatctttggtatcacatgaagggatctagagggaattttaagtgactctgaaattccttgagaaatacacaaaaagatcccactcaccccttttgggggtctcctgttctccttgtggagtccagagtcagggacaggctcctccaggtctgcagctctgctctcttttatttcatcttggctgattgctttggttttgtgagtaccaggcattactttgtactgtgagagacacgtcctttgtgagtgcaacggctgctgggtcactggtgagggctgcagtttggagatggctgagagccgttgcaataaatggttgtgattgcagggggctccttgtttctttgcaagtttagatgagaaaggtgcagtttggacacagtttaaaggctgtgaaaacaccaccaatgaatatgatttcctttggggatggtctgattaaaagtgggctgattgttgctgtgctactagccttgaagacatgtttctacagcattgtgcagtgtggaaaaattgtgtggcttggtcttgtggcatgtcccttcttttagagacctcagattcaatgtgaaattcgggatttttgattttcaaagatctagatgccctgccttccagatgtgcctactcttcacatattttaaaattagatcctataaactgcaaatactttgttggcttctgtgagatcagaggtccagttagaaaaggaagacagtttgttaaaattaaaaactatttatctaatctaactagattggcctccaaatatgactttctgacattcagctggttactctgaaaagatttctaaatctcttgaggctcatctatatgtttccttgcaaagaaaaaaaaaaaaaaaaaaaagcaagcccaagcactagtaagaaaaagatttgcaatgtttcatgaaaggagtagatgagtgaagcatttatttgtagatactgggttggatacctgtgcaaagaagaagaggtcaataataaaaattgccaggggatttcttggaacttaacaagctgaattaaatatagaaatgtcaggaaatcaaggcaggaaatactcacttgtggttaggcagacagggcagggttctgagcttgagatggagcaaacagttgtggtgggtgaagttcacatgctttagagctcagctgtcctagtaaagaagcctaagagtctctaaagctcttatgagaagatggattttttttgcctagattaaaaggttaaagaattgctttaagttggataaaataaagctaaatgtttaagcaagttgtgaaaggtttatgaaaaaattaattaaaatatttttgtgtgtaaacatattgactaaagttgaaggggtataattcagcatttctgtaaattgagcattgaaataaaaacacaatgggtttctcttagagcactaacctgctctttaacaaaaattgtaaagggttatagaaagtctataaaaatgttaccttatggtcaaacattaaaattgggtaaatatgtctatcaggttttattaagaattaggtttaacattaatagtacactaatgtaaaggtgaaatttggcttatttggtacaaaaatcatacaggaagcattgtgaaatataaaatgatttttagctttctttgggctatatttctataaatatgttattgatgagggttccaaagttatgggagactcctataattctgctatatctcagtgtacattatcagtcataattataattgtcatgttaaattattgtgggccacagaggtaacagatttccttgtcaattgtgtctttgactatgactaccctaaaacgttcagtcacccatatacacatgttaccttgttttggccctctttagaaggtaattttataatcagctataaagccctaacaggtgctcttaaatgcaaattttgataactttggagattgtgacatcagaagagaggaaaaatgttcgggacacttggagagctaaaatgttcattgatatcaagcaggacaggaattaactgcatgaagtgaactaataggaggctgaagtgatctttttgactttttgcttaaaacgttgctgatcctttgttttgcttttcagagtcaaggcaaattttcttttgagctattgacagcttttaacgattaatcaaaatatactcctatgaacaccatttggagcattatttgtttctctctacccgatttccccagaatttggaaactatttgtgggtattcttaatttatggcaatatagttatttgcataagtgcaataagaatgtgttttctttggtaacaggacacaatttgaaaaactggttattttaccaaggttttgaccagaatgctgtgctttcctttaaggaatcaaacttgacttgtggagctaataaagcctttggaaaactgaccttatatcctgtgaacacagtccctgtacagggttactgatctgtgggaagaaaagaatgtcacattctgacaggtcaggaatcccaagttatcttgaaacttcaagaggacaggaattcacccaaccatatgtatttgatggtagaaatccatggcaggggctcagctttaaaaagtcttatctcagattccttctataaaacaaagtcccattaaaaccaattttaaaagcctatgtgaaaaataattattcttgctgcacctcgtacaaataaagtggcaaagcataataaagcaaattggtcctgtcgtaatttgtctttagtaaaaacgggaaactggggtcgggtgcagtggctcactcctgtaatcccagcactttgggaggctgaggtgggcagatcatctgaggtcaggagttcaagaccagcctggccaacatggtgaaaccccatctctacaaaaatacaaaaatgagccgggcatgatggcgggtgcctgtaatcccagctactcaaggggctgaggcagggaagcggaggttacagtgagtcaagatcgtgccacttcacgacagcctgggtgacagagcaagactccatctcaacaacaacaacaaaaaagggtaactggagagagggaagttatgtttcaaaaacttttggaaactatagtacacctgtttttaaattctagtctggcattcagtttttattattttctacagtttgggttaaattcgtatttctctggctacaagtctcctaaataatcttttcatttgtttcctttttctttccctttttccccatttttcttaattggaaatcactgaaacctaagctgtgctttcttaaagccctgtgaactgaagactagacaaccgaaacttctgaaggaagtagcagcaacctatttatatgtgttgctgttgcctactattatgttttagcaggtgctgcctctacacccccgaaacagagagtgctactgggaacaaatcgactttttccactccagtgctgcattcggtgccccataacgatgaccccctctcagcaggaagtagccagaaagattacaatgctccatctccctatgattcttgtgataaataaatatacaagcatgatagaaatcatgcgcaaattgacagtggggattgtggcaggccagatttcactaatggaggtccccatcacaactacttcagtactgactgagtggttaagttcagtatcaaaagctgaaagtgccagcgcctttctacaaaggctagaatgtaacaaaagcccaccaagggttttacctaggcctttcctgggccttacagcatgacaaaacaaagaaggaattcttaaccagacctgtttaggattaaacaaatttaattgggggtctgaagaaactcgccaggcctccacaaacaagttcattgggggtctaaaggaaccccccccaaacctctgtgattgagcaggagacaaggtcagggtaattgccccagcacctggactcatttagatttaagtaaatgtactgaggctccagagaaaggtctccaagacttagactagagttacagattaaaagaagttaatcacttatatctttagataaatgcacactgacacgtagacatacatcttagaaaatatataagctctggaaaaccttgtaatttacagttggtctggagatattttctgggccttctctctgtaaccggttccagaaataaaaaactctcttcctccccagtttatctgcatctcgttattgggccgtgagaaatagcagccagaccctgagtttggtctgggaacacactggctgggcttcctgcctggcggtagagcttcactgtcctccttcccagccaaaatgtggcccttgaaggcttcctccccaactgaccggttttgggttctaggtactcagggaacaccgtcttcaaggaggccattttcatactgttcctggtttgatttttctgaaattaggaaatgccccttgaggcatccaggattgtctttatttcccctgaagcttcccctcctgaagaaaaaagttctcaaacaccctcaggactcaaaccccaagttcaccctgtgaaacattcccatttcctaaacccaggcaggctcatggccctcagcctctcagaccccatggaaacctcctcccccacttcacgggttctctccatattgagagcctcccctcctcggcacacaacccagagactcaccccaacatgtgtagcaaatcaccctggaaacaatcatggctgaacgtggtagcccatgcctgtaatcccagcactttgggaggcccaggaggtggatcacctgaggtcgggagttcgagaccagcgaggccaacatggtgaaacctcgactctactaaaaatacaaagttcactgggcattgtggtgtgtacctgtaatctcaactactcaggaggctgaggcaggagaatcacttaaacctgggagacagagattgcagagagccaagatcgcaccattacactccagcctgggcaagaagagtgaaactacatctaaaaaaaaaaaaaaaaaaaggaaaaggaaaagaaaaaaaaaatcatgaggcaacattgcatttaacaatattttatttatcaaaagacacttgtctttctcaggtaagtgaaggtctagagatgaaacgagtcccgatgtaaattgccccatgggcattgctgagatcacaagatcatcactgcagcatgcagcacaatagtaaatttctcaggatggaagttcaacaatccaaaaggtagtattttttttcatgatgctcagtccatcatacgaaataaaaataaattccttttcatgatcatccattcagtagaaaaaatgatagtaaatttgttctcatgaagatttttaccgtaacatataggatttatcgttattattattattctttgttttttgtttttttgaagcggagtctcactctgttacccagtctggagtgcagtcgtgcgatctgggcacactattaacctccacctccagggttcaagcatttctcctgcctcagcttcccgagtagctgggattacaggcatgcgccaccacacccggctaattttcgtatttttactagagatggggtttcaccgcattggtcgagctggatttgagctccggacctcgggtcatccgcccatctcagcctcccaaagtgctgggattacaggcgtgagccaccgcgcccggcctcaatttatcattattcacgcatccacaaactgggttcttatattttgtacgtgattttttccattgaggagagatatctgtgcatattcatgctgctcatatttcatccacaaactcggttcatatttcatccacaaacataattttttccgttgagaagagatacttgtacatatttatgctgttcaaattcacatttcatcattcttttacaagaaatagataatgtattttaaggttttccagtggtattacagatattttactgggtgtatagatagaaattaaaccaaacttctttgttctggccgccagtcatgcatcctgttttcaacatagttcacatacaactggttgtgtaaaaatgaaattattttgtttagtacaatcatcaacagttggttgattagatttttaattatcaagttaatcattgtcattatgcttctcatcgcactcgtcattaattgctgtgggaggaaatttgttatgttccctatgagagggtgtatcacaaattcaaataagaattcaacgacaatggactgtataaaggaaataagcaagtccatggaaaacatatttttttccggaaaggattaaaatatttttaaaaaggaattaaaaaaaaattgggcacggtggcaaatgcctagagtcccagctgctcaggagatggagacagaaggattgcttgagcccaggaataagttggaggctgtagtgaacagtgattccaccactgtactccagccagggcaatagagggaaaccctctttctaaaaagacaaaaagaaacaaaacaaaacaaaaaaacaccacatcaaaaaacccaacaacaaaatgaaaaaccaaataacagcaatacaattggagctattcgatccaaagaagtaaatgaaacataaagcaaataaaagagaaaagctaatacctgtgtcctgcaggactcagtccaagttctgctctgactccctcctggtgagccaccccttaaaaagtcacttggggcggggttactttgacagacagtcttctgtcaaagagggaggcggtaaatagcacttttttttttttaatttaacgcctttccaacaaattagcggctatgttgtctaagagtgcaaatgtcagaggtgggtacaggcagcaagaccctccccacaggggcagcagaaggaggaatgactaagggaacaagactttagtgtgctcaactacacaggacaggaaacagatgctttttacaaaagctggtggacttgaaggcagaatattttcaagttcctgtaactgcgaactatgacctgtagcctgtgagagtgactttctgtggcaaaggagcttttgtgaatgtgaggaagttaattatcttaacagtgggaggttctcccggcttatctagctagaccctcgtgaaatcccaagtgtccttaggaaggggaagcagagagagatttgagtccagaagaggaagaaggtgatgtgaggcccagtaggggaacaaagggcgatggcatgtaaacacttagcccccagaagtgggagagggctggggttcatcacaccagaatccctaacaatcagccttattttaattacccttgaaatggaaggaggccttagagagccagaggcttggaggggcaccctctgctgcatacacagatcccaactgctgtgggctccaaataattgcaccagggaaatcacaaattatcaaaaataaaggatgtaaagcttttaaaaaatattaaaagcccaacaaataaaaaaagttctaaatctataaaattgacctcagtctgtatatttagatgagtcatgtgtatatagcgtttcacttcaaaatatatgataaatctctcattcattggcttaaaaataaacacttcaatcaagtctttatcagaaaaattgaaacgttaactcaattgccttttagttcatgtgactttacaaaacttaaaacaataaagtcagttttaaaaattattagtaaagtaaaagaaaaatatcttcacaatgtagacattttgtccacatgagacatgtgaaatattgccattactaaatatttgcaggtcaaaaactgtttccaaaacattttaaataatcatctggcctgtctgttttagagcattcaattctagctgaggtctggggacatgtgaaaggagccacggcccgactccgtgctgggaagagtcagacattttccacagctctgtcctttgctgtgggctctgcaactcctaccaattaaaattgcttacgtttttgttttatttttactaaagaggggttcctaaaagctaacattatactgagtatatgtaactaaaactactaagaaaacaatttcacaattatacaaatgtgccaagtaaatgaaaaaataaactgtattttaataaaggttataaaaagaaaaacatatagtggtgtgaggactgtctcaggtcttcactgagcaagggatcatgacattctatggcggacagctgaccttggctttctgctcctcttgattatgtctactaagtgacatacttactctttttccacctgtcttgcctctaagggtaacaggttttatgagatccctcctagtgctttgcaggtcagcctccctttgctgcattccaattttactgcctataccctccagctggcttttgatgacaaaagtcctggtcccagccattctcagattctgtcatccccgtgggcactatggagctcagcactatgggaggttccccaaaaatctcgttttctatgaggaatggccaccacctgcatctcagtgatgctagtgacccctttcctactcctgtgctcactggtcctcatgaagatcctggttggtctgtagccccctatttttcctattaaagagaaattacagtaagacccatttgtgtgcaaaatcaattttaggcttattacacttggcctgataatttgcataaaatgcagcaagaattcatcggccatataggctacttttgagttaattttcctgggtttttacctaaaaatatactattttggttagagtcttgtgaaaataaccaatgtgttcaattgttttattttaaaaggctcttactgaacactataaatatgtataagttgaatatacaaactatattgtcataaaatcacaacccaaaatgtggagaacgcagagggaaaggtaaatttgctcgcaaaaacatacttcacccaaataactggaaaaaaaaaaagactttcatgacccttctttaaccagagcagcagctttcaaacaaggtgtttgccttggaaatgccattcacaagccaaacggcccttgagagctgtctgtcaggcactgtagaatctagcagctcctcacagagttagaaatagtttcaggaaagagattccctgcttttagtaactgcactttatattcccagatagcgagattgtatgtaaaccatttttatcttattctggaactcttttgggtactttttttttttttttttaaatgatggagtctggctctgttgctcaggctggggtgtagtggtgcgatttcagggtatgagaaaatgcagctggacctggctctttccaggaagaccctcacagccaaggagtccaaagcctggggttttcatctaattccagtgtgactggggtaggagcagctttggtgctgggtgtgtgtgtgtgtgtgtgtgtgtgtgtgtgtgtctatgcctgtgtctgtttagggtgttaggctcgtggttgtctagatacaaatgtcccagggctcaggagccccagggttatgtcaggggcaccagatgaaggtgtcaacagaagttagggcacaagggacaaaggtgagagcaaggttagattcatttaggtgcaagaaatcatagagggaggagggagaggaagccctcctgctaccaccgaggaagaagcgcagcttaaggcagaaagcctgtccggagaggaagtgagtttgagggcagggctctctgggtaaagtacggtctgggacaccagcctgggggaagggtacagaatgcagagtggcctggcgtggggactaagaacagaggagagcagctttcactgggagggtcagtgttttcagtgtccagcactgagcaaggtgagatttgggcagcttgctgtgaaataaggtcaggctctggcattgtccccattgcgtgtgtgtgtgaggggcactttgggagagtgaactctccacctccatcctctcatacgtccttcaaccgagcttgccagttaccctgattccaaggagatctatttattgttgacaatactggatcctagcagaggctgggtaggagcctgggcacaagcaagtggaggagggggcctgggcctgaaagacctgggaggtttgagagaggacacagcccacagaatggagcagatggggtagagtcggcaagcattcagggctcctagtaagttggacaatggagaccctgaaagatccagtaaaacggggagaacaaacaggtccccaactcacatccttgcagtgcctggagcttcagactccagacaggtggggaaggaaaattgagggatgtgaacatgttggagaatgtcgtgccctgaagaatgaagaaaaggggggtgaggaatgagagcaggaacggcttccagtgcctggtgcccaggagaactcagaaaatgggtgtggtggagaggaatcgaggaaccggaagtggtggaagtgtgcagggcccctccgagatcactgtgactgccaggcgtcctccctggctggagagcttcactgtcctccttcccagccaaaatgtgtcccttgaaagcttcctccccaatggactggttctgggtcctatatatttgaaggggtggcctgcctctccacacctgtgggtatttctagttgggtgggaggagagacagagaaaagaaataagacacagagacaaagtataaagaaacaacagtgggtccaggggaccagcactcagcacaccaagggcctgcaccggcaccggcctctgagtttcctcagtttttattgattattattttcattatttcagcaaaaaggaatgtagtaggagagcagggtgataataaggagaaggtcaatgaaaaacatgtgagcaaaagaatctatatcataattaagttcaagggaaagtactatgcctggacgtgcactcaggccagatttatgtttctctccacccaaacatctcagtggagtaaagaataacaaggcagtattactgcaaacatgtctcacctcccgccacagggcagcttttctcctatctcagagttgaacaaatgtacaattgggttttacaccgagacattcagttctgaggggcaagcaggagacagtggccttcctccatctcgactgcaagaggctttcctcttttactaatccacctcagcacagaccctttatgggtgttgggctgggggacagtcaggtccttctcatcccatgaggccatatttcagactatcacatggggagaaaccttggacaataccccgctttcaagggcagaggtccctgcggctttccacagtgtattgtgcccctggtttattgagactagagaatggcaatgacctttaccaagtatactgcttgtaaatattttgttaacaaggcacatcctgcacagccctaggtcccttaaaccttgatttcatacaacacatgtttttgtgagctccaagttgggtcaaagtggctgggtcaaagtggctggggcaaagctacaaattaacaacatctcagcaaagccattgttcaaagtacaggtctttttcaaaatggagtctcttatgtctttcctttctacatggacacagtgacagtctgatctctctttcctttccctacatatattcatggaccacagtcttcaaggagtccatttcctcactgtttttggtttgatttctctgaaattaggaaatgccccattgaggcacccaggattgtctttacttcccccagagcttccactcctgaggcaggagcttctcaaacaccccccaagactcaacacctaatttcaccctctgaaaccttcccatttcttaaatccaggcagggtcatggtccttagcccctcagatgctgtggagaccttctttccctttcatacattctctcaagattaaaagccacccctcctcagcacacaccccagagactcaccccaacatgcattgcaaatcaccctggaaacagtcataagaccacactcatttaataatattttatttatcaaaagacactctttctcaggtaagtgaagttctggagaggaaaagaggagtcctgatgtaaattgccctgcaggccttgctgagatcacaaggagattgttactgcagcttgtagcacaatagtaaatttcttctctggatggaagttcaacaatccagatcgtagtatattccttttcattatgctcagtccagcaaatgtgatgataacaaattccttttcatgatcatccattcagcagagaaaatgtttgtaaatgtgttttcatgaagatgtttaccataacatacaggatttaccattatcaatgcatccacaaactctgctgttgttttttatacataattttttccatcgagaagtgatagttgtacatattcatgctgttcatatttcaaccacaaactctgctggtttttttatacgtaattttttccattgagaagtgatacttgtacatatttgtgctgttcatatttcatgtttcatcatccttttacaataaataggttatattgtattttaagtttttctaactgtagtgcagaaattgtactgggtgtatacatagatatcaaaccaaatttacttgttctggctgataatgcatcatttatttcatagattatgtatttctttgacacatttcacgtacaactaattgcataaaaatgaattttcttttagtatagacatcagcatgtgcttaattcggaatttaattgttgagttaaacatcgtcattgccttttccgttgttattaattgctctggtgggaattttgttatctcatacataagacagtgtgccacaatatctcttaaaatttcaatggcaataaactttatatttaaaaacagggaatctatggaaaacacatttttttctaaaggattaaaatatttttttaaaataattttctaaaaagttaggcacggtagcaaacgtctagagtcccagctactcaggaggctgagacaggaggattgcttaagcctacgagttgggggctgcagtgaactgtgattgcaccactacattccagccagggcaatagaagttaaccctttttctaaaaaaaaaaaaaaaagaaagaaagaaagaaaaaaagcaacaacaccaaaacctcaccaacaaaatggtaaagaaaaaaaaaacagcaatacaatgtaagctatttgatccaaagaagtcaatgaaatttaaaacaaatgaaagggaaaaagtaatacttgagtcctgcaggactcagtccaagttctgctgtgcctccctcacggtgagccacccctttagaagtcacttgggtcataagttaacccgataggaagtgtcctggccaatgaactagggaggtggtaaatggcaccattttaaatttaaattcacggccttttcaacggatcagtagccatgttgggtaagagtgcaaatgtcagaggtgaaaagaggcagcaggaccctcccctagtgcttgggcaacagaaggtggaatcactaaggggacaagactttagcatgctcaagtacacaggacagaaaacatgctttttacaaaagctggtaaatatgaagagggaacattttcaagttcctgtaaccaagaactaccgcctgtaaccggtgaaagtgactttctatggcaaaagcgtttttgaaaaggtgaggaagttaaatatcttaatgttgggaggttcttctggtttatctggctagaccctaatggaatcccaagtgtccttatggagcggggagcagagagagagatttgagtccagacgaggaagaaggtgatgtgagtctgggtgcgggacagggggagaatgatgctatgtggggatctgggctggggaatgacttagctgcatgagcggagtgacttagactcctgaactagaagaaatctagggctcatcacctcagcagccctaaccatcaaccttatttttattacaggtcttccatcgacggactccctaaaaagccagcggcgtggaggggcgccctctattggacaaatagatcttgactactttcggccctcaaatagcctgactaggcaaataacaaataataataatttttttttaaatcatggaaaatattttaaaaaacaattaaaaagttataaatctataaaatctgcttctgtctgtgtgtctgtatatttagatgtctcatgtgtacataatgtttcactaccaaaatatatgatgaaaccctcattaatcggcttagaaaactaaacacctaaatattttctcagaaaatacaaaaactttaactcaaatcccttttaattcacctgactttaaaaatctttaaaaaataaagcatgctttaaaattattagtaaagtaaaattagaacatcttcagaatttagacatttggtttaaattatacaggtcaaatactgcccttagtaaatattttcaggtcataaacaactcctgtaatcttttaaataattgaattacatgtctgttttagagctttaagttctagctaaagcctggggacaaatgaagggcaccatgccccctctctgtgctggaaagagacattttctacagctctgacccttgcagtaggctttgcaactgctacctatcaaaattgcctacatcctaagtttattattaaaaggagttgcttggagttaacattataatgaatatatgtaactaaaactatttctcatacaaagtatatgaaaaagtagaatgtatttttaataaaaagttataaaaagacatgaacatgtagtttttataaaaaacagtaattttgtctagttttgcagttctaaaaagttatgttaaattcaaaaataaaaaataacaagacaagactcaaggtttaaataagttgtaaaagatttgtaaaaattagttctataaaaattttacaaaaaaaagcattggttaaaatttaaggaattattttgtttttacagaaattaaacattcattaaaaacactctgatacaaggccttaatttgggttcatgtatcagaatagcagggttttcttagaatattaatctattctttaaaagaactatgaatgttatgcaaactttataaaaatcttaccttagagtcaaactgattaaaattccatagattttacgtaaaattttattaaaaattaacttcaacaaaaataaaatttgattttctcctttaaacaaaagttttgcgtaatattaaataataaagcatttttgtttaccttttaaactataaacacacacacacatacacatacaccaacactaaagtcagctgacctcatactgtctttattggatattcttgtttaaaaaactatcttctttggaaaataaagttttttattttaaaccatattttaaattatcattttgactaaatccataacatacagtgatctgtaataattctattttataatatcaagtgttttgaagaactccaggaacagccatgagagaacactgtggtttagtaacactttatttcctcagtttgaaaatagttgtctttcttggggaggccggtttcagcagatgaaaacaagagtcatgatgaaaattacccagcagtggttagtgtgaccataggaacattgtcatcaggtcagcagaaaacatatcagcaaatttttctcatactggcagtgtgtaggggtggatgtttacagttcctgaagccccagtggtcgtgtggtcttttagttttgccatttataggcaacttgtggtaactagctcaattagacacattccttatcacaaggacagagggctttctgtatcctagggttcttgccttggcattccagaagaatcaggtcacacgtggacgtggagaatgagtgcaaggttttattgagtggaagtagctctcagcagatgggggagccagaaaggagattggtttctccctggattggggccgttcagcagccctggctctcctctgactgccccaggcaaaatccacatcgttctataagtcggtgccctgctggtgtgctggtgcctgttgtcatgttcctcttcatgtccagccgcctgtgtgttcctccgctgatgtgctcctctcgacgtcaagcctcctgtgtgtctgactgctagggtcttggggtttttataagcacaggatgggtcttagcaggccaggatgatcttgggaaagacaacattcggtcaggaaaacaaaaatgcctgttgtcatctaggtccgtggggacaagcccaggtgtggagcttttagccagggaccacagcctcctgtatccaacacttcccttcaccttttctatatcattcaaagggatcatgcccttcccatcccagcacttcactttcatgtcatttgccccctctgaagaggtacatctaactgccattagaatatggatgatgaccagtcttagctgcttcctgctgaaagggggcattgttttgggggaaaacggcagtcagattcctcccaggggtctctataataaaagatcgaggtggctactttcaggaggtcctctaatgtactatctggtcccaagtcccatttctgcaacctcctcctgatgtcaggagctgcctgagtaataattttatcctttaggattatctgtccctcgattgaattaggagatagagaggtgtgatttaccaaggcctctcttagcctctccaggaaggcagtgggattttcatcaaatccctggttaattatggacaacttagtataattgagaggcttggtcttagacctacgtaagccctctattatgcacacctgaaagtgtctcctcttccagtcttccatctcattattgggatcccatttagggtccttcactggtgctacttctcttccagttggataatattcgctcccttccctgatgctataggtgatgcaaagctcatccccaaatctctctgctgctggcagagcagcctgcttctcagtgtctatcaggttctgactcaaaagtaacataacgtctctccaggagagttcaaatgttagggtgaaattctggaaagcttctatatatctatcagggtcatctgaacacttgcccagatctcccttaatttgctttaagtcttgtagggaaaagaggacttggaccttactgggcccaaattcactgggcatctgtaggaggggcaagagtgagactgggcttgtttgggatgaagatttctaggaggggccaggtgagaggctgaagctggatacggaggttggggtggacccagaggagcagggcttgagggagctggcacgtcagctgggggtgcgtctgggactcgtgtctttaattccctgggcttgaccctggcagccttccccgagacagcaaacaggagggctggaacaatcctacatgtcagcaaaggtctggattgctttgcaaggtatagaaagcctgcacatttggggcctcagaccatgtgtcctcacatccagagaaaagttctaattgcaggatggtattgaaatgaatggtcccttcctgaagccaagccagtccttcctgtaaaccataatttggccaaacctatgtgcggagggctatgagatgcttttcctctggattctgagggtcaaaacagtcccaatggttcaggatacactcaaggggagtacaagctgggggtggtgaggagaactggctgcccattctgaaagacagggaatagaggtgttcctcatttcccttccttcttttggcaaaaagctcagggtgtgatggggagggaaagcaagcatcttcacttcactttccacctcttacccctgcgccctggcaaccttggcaggtgccggccacaggtacaaatgcggtatgtacccatgaagcagggagaacctggagattaggaattaactgccctcacctatgtttccttttctccctgctgttgaaaaactttgagttccctgggcctttttatcccatgaggcatggcctccttctgtgggatggggttcagtcagcaggaattggtcctgtccatttacattgtgcctgttgcctggctttgaattcctcagacctgctttctctttctagggcctcagcctgaagcttggaattgagtttgggactgaaaaagcatttcagaggctgtttatatccatttagtgcctcaaataagccctgctgaatttgcaattatcagccagcaggggtcactcctctgttaacttccctattagaaacagagcggtggggattctcacttagaaaagaaaaaaagagaaaaacagttaaagaggcaaaaagtggggaatgctgggggaagaaccccttgcttagtgcaagtgggcccctctaatccttataactttcccatccttcccccagttcagaccaggttgaattccttggccatggaaggaaaggttccattgatgcagtgggtgagaagcactctgtagggtcctggctaccatcggttttctcacacccccctcatcccaggcagtggagggagacacttctgcgacattgctccccctgccccttcatggctattgggtgtggcctttgcctgctgcaggcatgcctaggtgctggagctgggagggaaaagggtaaggagaggtgccctggaagccgctcatgcctggggctgtcaaggtggaggcatacatggcacctctaggaaaaattggtctgatttgcacctttggcggctgagccaaatgctcattttacttagtaacattgcctcagcctgtagcaaaactcttaacattataaaggaagagataagatccatttcaaataatgtgtgagagagaaaagagatgaaaggaaaacagagtcttttacctgcaggaaagggagagaagtggcagagttttggaagaaaggcaggcccaacagtttcccattcactcacactcaccttccgagatcccagacgagccaccagttgaaatgggaaaagtttccttgtccccctcacaggaggtggagtgggggtgtggcttgcttctttagtactccgctgctcaaacctctagggaagcatacagactggcaagttgtggggctacaaccccatggcagcatctaggggtagatgtttacagctgctgaagccccagtggacatgtggtaccatgtgctcttttagttttgccatctataggtggctttgtggtaaccagctcaattagacccattccttaacccaaagacagagggctttctgtatcccgcggttgttacctaggtgtaccagaaaaatcaaatcacacgtggtcttggagaatgagtgcaaggttttattgagtggaagtagctctcagcagatgggggagccaaaagggagaatagttttcccctgaagtcgggttattcagcggcccaggctctcctctggctgccccagccaaactctatgtcaatccattggtcggtggcctgccagagtgctggtgcctgttggtggattcctctcagcgtcgagagtttttccctctcaggaaagggagagaagtggcagccacccatgtgttcttgcactgatgtgctcctctcgacgtccaacctcctgtgtgtctgcctgctagggtcccagagtttttttaggcacaggatagggcatggtgggccagggtgatcttgggaaatgcaacatttggtcaggaaaacaaaaatgcctgtcctcatctaggtccaggggcacaagcccaggtttggagccctagccagggaccccggcctcctctacccatcactttccttcaccttttctgtatcattcaaagggaccatgcccttcccttcccagcacttctcttctgtatcaataggtgatgtttttaaaatttcccaactctagtgcaggcatggtactagacatatacatagaaataaaaccacacttattcttctggctggcaagacatagtatttttgccaaattatgtgttgttttgaagcattttatgtacccctggtcatataaaaataaagctattttgttcagtacaaacagcagcattttctggattagaaagttaatcatcttaaaagatcatcacggatttttccattgcactcatcactaattgctttggcaaaaaatttcttatctcacgcatgacaaaatcagccgcagtatctcctagtaatttaatggtgatgatctttataaaggaaataagcacatcaagggaaaacataattttttttaaaaaaagagtaataaaactttttaaaagtcttttttaaaagactgcttttctaaaatagtaaaataaaactccaccaataaaaccaccaacaaaacagaaaagaaaaaataatgatatgatcggagctatttgatgaaagatggtaaattaaatttaaaatgattagaagagaaaaagcaatacctgtctcccgtaggtctcagtccaggttctgctatgcctttctcctggtgagccacctatttaagagtcgcttaaagcatatgttaatccaacaacagcagattaaaaaccaatgcaatctgaactatttgatctaaaaacataaataaaatttaaaacaaataaaagagaaaaagcagtacctgtgtcctgtaggtctcagtccaagatctgctctgactcccttgtggtgagttagccctttagaagtcacttggggtggggcatatgttaattccactaacattggttctggccaatgagtcaggaaggtggtaaatggcaccttttcttcttgctgatttctttcagttcctttggagtctggacattagtcctttgtcagatgcctagtttgtgactactgtttcctatactgtgggttgtgtgtttaccctgctgatatttcttctgccttgcagaagattttcggtttcattaggtcctattgatcttattctatttttatatttttgcgtttgcttttggggcattagtcatgactacttggcctaagccaatgtctagaaaagctttttggatgctatcttgtagcatttttagactttcaggtcttagatggaagtttttatatgctttgttaaagatcaggtgactgaaagtaccgggctttgtttctcggttctctattctgttccattgctctatgtgcctatttttatacttcctgcaccatttattgaataaagtgtcctttccccaattagtgtttttgcatactttgttgaagattagttgtctgtaagcatttggctttatttctgggttctctattctgttccattgctctatgtgcctatttttatacttcctgcaccatttattgaataaagtatcctttccccaattaatgtttttgtgtactttgttgaagattagttgtctgtaagcatttggctttatttctgggttctctattctgttctattgctctatgtgcatattttataccagtatcatgctattttggtgattgtagccttgtagtataatttaaagcctgccttcagatttgttctttttgcaaagtattgctttggatatgcggtcacgtttttggttttgtataaattttaggattcttttttctagttctgggaaggagaatgatgatattttgatgagaattctactgctctgtagatggctttggagagtatggtcactttcacaatattgattctacctattcataagcttataatgtgttcccatttgtttgtgtcaactgtgatttctttcagcactattttgtagttttccttgtaggaaacttacattaacctacttggttaagtatatttctaagtattttacttattaaaaattctcagggaaatgcaaagtaaaactgaggtgggaaattaaagaaaaataaaattaaaaagaaagggaaataagctttcttgtattaagctaacttgtcccagaggcagcaacaggcacagcccagacccaggaaaagtcttgataatattatttattgtattctggagactcttccagcactccttcaatgtagggagaagaaaaacaaattttcctttgttttatggtatgagtttatagattcttgttctctttaactagtaacttcaagtattctgttttatctaagaagtatggcaaaggtcatgagaagcctgagcaggcctgaactacagctctctaggcaccatagtgaagataaaccaatgcaagcctctttagagcaaaacctagataatagacatctgggttgcatagcaacagttatgtgcaatcctgagttatgaacctgttacaatttgattaactgtctttttcctgcctctgtatccctgctttcacaccactgtaagcttgcttcaagctggcccacccccttttgtgaagtgtgtataaaagtcaagtgctgtctttgttccaggccctgtctttggacgtgagtctgctgggcctgagagcactcaataaaagattctcctgttttaacccaaagcctctctctcatcctcctaaatcccacaacaaaaccacaatgagatgctatcttaatcttgctagaagcccataatttaaaagtcagaaaacaatagatgttggcatagatgtggtcaaaagggagcactttgacactgctagtgggaatttaaactagtccgaccactatggtaaacagtatggggattccttaaagaactaaaagtagaccattcattccagcaatcccattactggctatctacccaaaggaaaagaagttattccataaaaaagacacaagaatatggatgtttatagcagccgattcgcaattgcagtgatatgggaccaacttaagtgcccatcaacgaacgagtggataaagcaaatgtggtacaccatggaataatacttgataataaaaaggaacaaaataatgtcctttgcaacaagttggatggaactggaagccattattctaagtgaagtaactgaggaatggcaaatcaaatattgaatgttttcacttttaaatgagagttaagctatgagaatgcaaaggcataagaatgatataatggacttggggactcagggggaaaggttgggagggggatgaggaataaatgatgacatattgggtatattatacactgctcaggagacagatgcctcaaaatctcagaaattaccactaaggaacttttatccacataaccaaaaaccacatatattccacacactattgaaagaaacataaacattattttaaaaaataaagccacttttaaaattagcaaaataaaataaatatgtcttcagagtttagatattggatccaaattagacagatcaaatactgcctttactaaatattttcatgtcattaacaacttctaaaacctttcaaacagttttttgacatgtcttggaaccatccatttctagctaaggcctgggcacctgtgaaatagggccatgcccccccttatactgggaagagtaagatatttcaagactaagatgttttctacagctccatctttttctttaagctctacatcaaggacataattaaaattggttgtctcctaagtggtttactaaaaatgcatacttaagagttaccattataattaatatttgtatctaaagctacttaaaaattttcacacacaaatctgactgaacaagtaaaatatattttaagtcaaagtttataaaaggacatgagaacatagcttttatgaaaaaattagttttgtcaagtttagaggttttcaaatattttaaattcaggaaataaaataacaaaaagacaaaagaaaatggttgaacaacttagaaaaggtttgttaaaattcatcttataaaacaatctacatgtaaaaagtgggctaaaatttgaaagagattatttaggttttccataaattaatccagaaggggtaggaagtcttaagaatgaggaaggacaggaggaaggggaggtcatcctgacactgcagaggcagaagtgcagctgaaggtatgaaggctaagaggggaggggagtttgagtgctgctgcctggctgtcagagcagaggagggtcctgggcaccagacttgaggaagggatgaaaatgctgggcagacctgtagtgggcccttgagatggcagatagtggtttccagagagagggccattgttttccagtgcccagcactgagcagagagagttttgggcagtgtaaaaaaaaaaagagaacttacctctttctcgttttagaaaaagaacagtctaagaatatcagcagggaaactctcagtgcttcaaggggttaaacgcccttttggctttcttgtgttggtttcatcatagaggaggagaaacttcttggaagtgttcctaaaaacacaacacgtctgcttctcctttcaaaaaaggaagtgctaaaacacgaacactctagatccaaatattaatacggatgtctaaatgcttccgttttccaaggggcagaaagctaaaggttgtaacctattcatttcagtcaaagttggtgaaagggaagcaaaggaactgggtggggcttggaaggatgacgaagctcaagctcattggccagcaacctctctcctgggggcgggaggggtgagcatacgtcattgctttggcttctataaaatgaggaggactcaccgagtgtgaagagtccttctggtgattgcagctgagagcacactcacgacgttctgcaaggattctctgattatgattctgaagggaaaagcgatggaatggacagcagagattgtaattttctttatcttgaattacggaagaaagtatctaggacagaaatccacgacaagtccttggaaccagcagatctcttcgttcacggagacgttgacgtattctctattgaagaagattcttaccttcttactggacaaggttttgtcagttctgcgtgactggattgtccgggagactctgaggaaactgatgtcacatgtttttccaaagaagatgtttctggaaccaacaactgtgattgtggtttgaggacttctgagagttccagtacaggaaataagcagaacatcagctggaggctaaacggatccagacttcactcttcacttcccttcctattcagtctattgtgcctgctgactgagaagcttggctggtatgtgagcaaataaacggaactattcagaaggagatgttgacatattctgtattgaagaagatccttatcttctcacctgacaaggttttgtcagttctgtgtgactggattgtccggaagactctgaggaaactgatgtcacatgtttttccaaagaagatgtttctggaaccaacaactgtgattgtggtttgaggacgcctgggagttccggtatgcgaaataagcagaacatcagctggcggctgaagggatgcagcctccactcttcacttcccttgccattccatctattgtgtctgcctgactgagaagcttggctggtatgtgaggaaataaacggaattataaacaaggagattgtttctcatctacttcattctgttgtggcttttctattttggggttcagggtgtgtgacaaggaccaaggagatgaaaggtttcatgatggagaaagcccaggcaatcagattgaagagctatccacagggaatcttggctgctgaggggctgcaccctgcaacggactgaccatatgacagaaaagggttttaaaggctcaacttctggactgagaacccagagtaatttgggaacctcctctgtgaggagatatgaaagctgggaatcatgacatccctaggaatggaaggcacatttcctgatggaaggggtgctttggaaaacaggagcagagtagacacagcagccttgtggatacgggtgggcagcatgcatgggtgatgtgaacgtggagtgtttgtgatcgaaactcaaaatgtctgacaaagtgaaaacctagaaaccacaatgaggaggaagagtttgtgagggcaatcactctccccatgtgtgaaaatcgggggctcttaaaatctcatctggagaggtgcagtctaccaaactctgggactttagcctccccttttaaaaaaccgtgcatcaataccaacgtccgaaaccacagaaataacacctggcttgcatggagacaaggacaaaaagccgtcatgatgagttgttctgctcacttgctgcctctgttcagtgcacaggatattgtccacccactagcaggctactgcaagagaagtgtgcaatatgttccctatgtgccatatatgtgccatatggcccatatgacaactgagtcagaaaatatctgatgccctcagagttacactccacctggagcttgcccccagccatccaggacctaggctccctaccctgtccaattttctggtgttttgggggcttcattctctaaggtgtgcccactctttactcaaaccaaaacacccacatattcctgcccatgaacaaccaatcaaccacttctcagttccacatcctgctgttgggtctctagtggtgacactgtaactcccaggtcatagtggtgacactataacacctagctaaattgatgccttgtctctaggaggccatgggctcctgcaggtctcatctgactctctgtagccttccctgacaatgctcacaatacccaagccagagccacattgacagcaagctgctctcatcttacctttgccagacctggccactggaaaaggctgaccctcatcctgcaatgcctatacctccaacctttgtctcaagctggtgtcctggagggacttctaagcagaaaacagattcagactcccatcctctcctgaatggcctcatatccaattctcagaccctcagccttcattgtaaggacacttcatccatgcccttgagtattctgtctgcactgtgtattctgcaatagattctcctccctctgcgaccctcaactccttccgcagactttttgttttcttgatcatctaccatagtcttccactgggacactgccaagcccattctggagagtgagttgtgcaagtacactgccccccatctacctttcgggaggtgtatacacccttctttctcccaggtctggaggctttctattttcatcctgaggcatctccacctgctcttggattcttcaaattgacaaccaccagttaacaagaactatgtgtcaccaaatagccaaacaatggcaattacaaaaataaaattaatagctgtaacccccattagcaaggatacacaaatcaaatcagggatagtgggtgaggaagtctgcctaacattcaaggaaggattctgaagtgatacaaaatcattgcctttgctatctttagaatggacactttcagccaggcacagttgctcagcctgtaatcccagcactctgagagccccagttgggtggatcacttgaggccagcagcttgagaccaccctgggcaatgtgcagaaaccccaactctactaaaaatacaaaaatagccagttattgtggcacatgcctgtaatcccaactccttgggaggctgaggcacaagaatcacttgaatctgggagccagagtttgtaatgagcgaagatcatgccactgcactctagcctaggcattagagtgataatctgtctgtggaaaataaaaacattcctcttcaaagttttcttctttaaatcataaatgttggaattaatatatcctctttgaaactcactttcttcaagcttctttatttgatggtagtaaatctttgttaagctttatgaggcaagagtaatggaagaagcatattatatatatttatactctaacctcagtgcttgttctagcaagctcaggcatgcgtgaatgtgcccaggcatgttccagcccataccttatatcctttccttattgggaaatgctgttactcctataagcattcttgtaagcaacttcctctttttctttgtctccactatctttacctattgaggacagttttaggttcttagccagttggatgtagcatagactgtgaggtccaaccccagccaatggagatagcacacagcagtagcgacctcatgcttaacagataaatattcctgtctccctttgtttggggtgctctcagctgatgagcaacaccctttctaaagaaattaaagttgtcttgctgagaaaacttttggtctaaatgctgattcttccttgcagcactgaagaagaagcaattatttccaacactttctcatacacaaaaaaagaagaaggtggaagaaaactttcttgtgcaccctatccctcactcagaaagacaacagaaggctcctagtggcaagccctagaggattcatttcttttgggaaccctcttggctgggatactaggactcaggtcaaactcagcattttcagtgtgtgggaagtgtgcttgggtttcactgttacttccaataatgtgatttggtccttggggttcaccaaattttggtatggagtggtgaaccctgttaagtttaagtgtctataaaattaacaaagcaaaataaccattctgccccatggttcagagaccaaatattgtgtaggaaatgctttagcgagagaaacagagaagaataaaaaatgtcctcaagcgctgcattatttcttgttatcgtccagatcttagaggaaaggctttcattttccctcattcagtatgatattagctgtgcatctgtcatttatggcttttattatgttggggtatgttccctgtgtatgtagttttttcagggtttttgttatgaagtgatgttgaactttatcaaacgtttttcagtttcagttgaaacgatcatatgctttttgtccttcattctcttgatatgatgcatcatgttgatgatttccatatggtgcactgtccttgcatcctgggcatgaattccacttgatcatgacaaatgaatttttaatgcattcttgaattccgtttgctggtattttgttgaggatttttgcatcaatattcatcagagatattggcctgcagtttctttttttttcttttttctttgttttgttgtttgtttgtttgtttgttttgatgtgtctatgtctggttttggtatctgggtagtagtgttccatccccttttattttttagaataatttgaataagactggtgttggttctttaaatatttggtagaattccgaagtgaagtcattgggccccgggcttttctttagtggaaggctgtttattatggcttcaatctcgttacttattattggtctattcatgttttgaatttgttccttatttaatcttggtaggctgtgtgtatctaggaatttgtccatttcttttagattttcaaatttattggcacataattgcccattgtagcctctaatcgtcatttgagttcctgcagtaccaattataatgtctccttcttcatttttgattgtatttatttggatcctgcccctttttttcttacttaggctgcctaataatttcttaattttgttgaactttttcttttgtttgtctcgctctgccaccaggctggagtgtagtggtgtgatcttggctcactggaacctccgtctcccaggttcaagcaattctcctgcctcaccctcccaaatagctgggactacaggcaagtgccaccactcccagctaatttttgtatttttagtagacacgggttttcaccatgttggccaggatggtctcgatctcttgacttcataatccacctgcctcagcctcccaaagtgctgggattacaggcatgagccactgcgcccagcctaattttgtttaaattttcaagaaatcaacttcttctttcattgatttctgtattttttatttccattttatttatttaaactctaagctttattctatcttcttctcattttagctttggtatgcttattgcctctctagctctttaatgtgcattgttagattgtttatttgaagttcttcctctctacaccataagacgtaagcatgtcctcattatgtcataagatgtaaccacttacagctataaacttccttcttagttctgcttttgctgtatctcataggctttgttatgttgtgtttccattatcaattgtgtcagaaatttttcaatatttttcttaatttcttcattgagcaactgatcatttgggagcatatttttaaacttccatgtacttacatagtttccaaaatacctcttgtgatcaatttctagttttattccactatggttcaagaagatgcttgatattatttcaattttttttcacattttaagatgtgttttgtgacctaacatatggtctactttttttttttattaaactttaagttgtggggtacatgtgtagaccgtgcagttttgttacataggtatacacgtgccatggtggtttgctgctcccattaacctgtcatctacattaggtacttctcataatgctatccctcccctaacctccaccctctgacaggacctggtgtgtgatgttcccctccctgtgtccatgtgatctatttttgagaatgatccatgtggattagaatgctgtggaaaagactttggattcctaatatccagggagggagacgatgatattactttcaatatcacacgggtgtacacactctctgtgacattgttcctaatatccagtggaagagaggatgatataacacccagggagggagaggatgatattactcttaatattgcagggtgtgtacccatgcctatgatattgttcctaatatcaggagggggagaggatgatattactcagaatatggcagggggtgtacacacactctgtgacatggttcttaatatacaggggagaatgggacaatattactctcaatatcgcagggggcgtacaaccctgtgatttgttcctaatatacaaaaggggacagtatgatattgttcctaaaatcgcagaaggtgtacaacgccctgtgatattgttcctaatatccagggcgggagaggatgatattacccccaatatcacagggggtgtgcactttccctgttacattgttcctatgatccgagtggggggaaatgacattagtcccaatatcgcaggatgtgtacactactcccccatgatattgttcctaatatcaagggggagagaggaggatattactcccaatatcgcaagggaggtacatcctccatgcaatattgttcgtaatattcaggaggagagaggaagatattactctcaatatcgcagaaagtggacacccaccctgtgatgttcttcataatatccagggaagcagacgattatatgactttcaatatcgctgggagtgtacatcccttttgggatattgtttctaatatccaggaagggagaggattatattacttccagtattgcagccagtgtacacatttcttgtgatattgttcctaatatccagaaagggaaaggatgatattactcccaatattgcaggtggtgtacacccccctctgatattgttccttacatcaaggaaaagaaagaagaatattactcccaatatcgaagagagtgtacacccctcctgtgatattgtatttaatatccatggggaaagaggatgttgttactcccaatatcgcagggggtttacacccacactgtgatattgttcctaaaatccagtgaaggagaaaataatattgctcccaatattgcagggtgtatacaggccctcccccgttatattgctcctaatatccagcggtggagaggatattactttcaatttttgcagggagtgtgtaccccctctctgatatttttctaatatcaaggatgggaaaggatgccattactcccaatatcgcaggaggtgtacatgccctgtgatattgttcctaatatccagggaggtagaggatgatattactttcaatattgcaggggctgtacaccctctatgatgttgttattaatatttaggttgggagaaaatgatatttttcctaatatcctgggaaggaaaggatgatattactgtaaatattccagggagtgtacaccttcctaatattctaatattgttcctaatatccaggggtgggagaggattatattactcccaatatcgcagtgggtgtacacccctcctgtgatgttgtttctaatatccaagcgaggagaaaatgatatcactctcaataccgcagggggtgtacaccttccccatcatatcgttcctaatattcagagggaaagaagatgatgttactttcaatatcgcaggggttgtacacaacccctgtgatatttctcctaatatccaggaagaaagaggatgatattgctcccattatagcagacggtatacgcctccctgtaacattgtttctaatatcaagactgggagaggatgatatcacttccagtatcgcaaggggtgtacacctcccccgtgatattgttactaatatccagggggaagaggataatattactttcaatattgcaggggctgtacacccccgtgatattgttgttaatatttaggttgggagaaaatgatattagtccaaatatcgcagagagtgtacacacttccgataatattgttcttaatatccatgggggagacgatgatattacacccaatatcgcagggggtgtagtctccccttgtgatattgtccctaatattcagggaagtaaacgatgatgttagtgtgaatattccagggagtgtacaccccctttgtgatattgtcctaatatccgcaggagagaagataatattactcccaatatcgcagggggtgaacacaccccctgtgatattgtttctaatatccaagcgaggagaaaataatattactcccaatgtctcaggggatatacaccttccctatgatattgtttctaatattcaggtggaaaacgggtgatattactcctaatatccaggaagaaaggggattatgttactccccttatagcagggggtatacacctcccctgtaatattgttcctaatatcaaggctgggatatacgtggggggaaggatgatattactcccaatatcacaggggttataaaaccttctgtgatattgctcctaataaccatggcggaagaagatgatattactcctaatattgcaggaggtgtacactcccccattatgttgttcctagtatgcagaaaaggagaggatgacattattgccaatatcgcagggtgtgtacaccacccatgatattgttcctaatatttagagggacagaggatgatattactcccaatatcgcagggggtgtacacgcatcccctgtgatattgttcttgaaatcgaggggaaagagaattatatttctctaaatattgcagagggtgtacaccgccccctgtgatattgttcctaatagccgggggcggggggagataattaaattactttcaatatctcagagagtgtacatcccccttgtgacattgttcctaatatccagagcaaaagagaatgatattcctcccagtatcgcaggaagtgtacatttaacctgtaatattgtttctaatatccagggggaagagaatagtaatactcccaatatcgtaggggttgtacaccttttctgtgatattgttgcaaatatttagaagagagagagaatattactcgcaatatcacagggaatgtatacttcccctgtgatattgttctaatatctagaaaaagagaggataatattactcctaatattgcagggggtgtacacccccacttgtgatattgttcctaatataaaggaaggtcgaaaaacaaacggggagcccagggggaaggaaggcaggcgaggaagaggcagcgccggggcgccggagggagcagccgggccgcggaagcgcgagcacgagaccggtcgcggtcgcagtcgcatttttgccgttgtcgcggccgccgccgccgaggcttacccggggatgtctgagcccgcgcctcgcggcccccaagctccacgctgcgcccgctgtcccggcctctaagggccgccacgtccctgcggcgcgcgcaggcagaaagcggcttcgtgccggcggagggggcccgggcgggccgggaaaggctgccccaggccccgcgcctaccccatcaccgcggccggcgccgggccgggaggatgagcggtgtggggctctgaagcatggagggggttttgtacaagtggaccaactatctcacaggttggcagcctcgttggtttgttttagataatggaatcttatcctattatgattcacaagatgatgtttgcaaagggagcaaaggaagcataaagatggcagtttgtgaaattaaaggtgacagctttggaggggaccacccttgattggatacataaattctgttcattcagcagacaacacaagaatggaattaatcattcctggagagcagcatttctacatgaaggcagtgaacgcagctgaaagacagaggtggctggtcgctctggggagctccaaagcatgtttgactgatacaaggactaaaaacgaaaaagaaagaagtgaaaccagtgaatcgctgaaaaccaaaatgtctgaacttcgcctctactgtgacctcttaatgcagcaagttcatacgatacaggaatttgttcaccacgatgagaatcattcatctcctagtgcagagaacatcaatgaagcctcttctctgcttagtgccacgtgtaacacgttcatcacaacgcttgaggaatgtgtgaagatagccaatgccaggtttaaacctgagatgtttcaacggcaccatccggatcccttagtttctcctgtgtcaccttctcctgttcaaatgaggaagcgttctgtcagccaccctggttcttgcaccagggaggagtagccactgtataaaagaaccagtatctgcacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgtagtgtccaactttctctaagtattgctatgcaaaagctgctgtaattgaactattgttatagggagtagttttttcccttaggactctgcactttatagaatattgtaaaacagacaaacaagaaaacaaaccacatacttttgaagcgtgttttatctttatatagtttgtttgcaagagtattttcctaataacttcacagtatgaatgtgcatcttttttttctttttttaacaaatgatggtgtaacattttgacatccataaggacaaatgtagatatttttctaaaaaaccgtgaggggactgacagcttggtcagggtgtattgtagcttataaacatgaaatcttacaaggtttcagtttgacagaagtgtgatatatgtaacttgtgccatggaccaaatggtcactttaccacagctaaaaatgagttatgatagcagcttgatggtgattgcattgtattcctttaatcaaaaaggaaacgcaatattctaagtatctttagcccaaataccatgacatattgagcatctttaaataaccagactgtattgtccttcatatgtgaagttgacactactgatttgtcaataccaaattttgggttaaagtgtttaatttttatttatttattttcttgttgcctcaaaagatgattgcattctaacttttgtgacctaccaaatttaagatgtgtatacattgttctttacgttgttctagaaaagagattttaatgctgtagtgacttagctcacttacatcagagaaataaacaactttcaatggaaaaaaatatatataaaggaaggaagaggatgatattacttctcatatagaaggggttgtacaccccccttgtgatattgttcctaatattcagggagggagaggattatattactcccaatatagcagggagtgtacacccccccccccgtgataatgttcctaatattcagggaagcagaggatgatattactttcaatatcacagggggtgtgctgtccccctgttatattgttcttaatattcaggggggagaggatattattatgcccgatatcacaggagaagtacaccccacaagtgatattgttcctaatatccaggggtaaagaggatgatatcgcaggtggtgtacacccctccccgtgatattgtttctaatataaagaaggagagagcatgatattactcccaatatcgctggaggtctacaccccccttgtgatactgttcctaatatccaggaagggaaacaatgatattgctgtgaatattccagggggtgtacacccctttgtaatattgttcctcatatccagggggtagagaggatgatattactcccaatatcgcagggggtgcacggccccactgtgatattgtttttcatatccaggaggggagaggatgacattactctcaatatggcagggggcgaacaccccctgtgatattgtgctagttaggttgggagaaaatgatattactcccaatatcgcagggggtgtacaccgctcctgtgatattgttcctaatatccatgacgggagaggatattactcccaatatcgcagggggtgtacctctcccctgtgggattgttcacagtatccaaaagggaagaggatgatgttactcccaatatcacagggagtgtacaccaccattgtgatattgttcctaatagccagggaagaaaacgatgatattattgtgaatattacagggggtgtacacaccccctgtgatatggtttttaatatacaggttggaaaaggatgatattactcccaatatcacaaaaggtgtacacacccccccatgatattgttcttaatacttcggtggggagaaaatgatattagtctccatatcacaggggtgtgaactcctccggtgatattgtttttaatatcaagaggggaggagatgatattgctttcaatatcgctgggggtgtacatccctcctgtgatattgttccttatatccaggcgaggggaaaataatattactcccaatagtacacaccccatgtggtattgttcctaatactcagggggaaagaagataatattactttcaatatcacagggtttgtacacctttcctgtggtatagttttcaatatccagggggaaggtacatgatattactcccattgcagcaaggggtgtacacacctcctgtgatattgttcctaatatccagaagtggtgaggatgatattactcccagggggtgtacaccccacctatgatattgtttctaatatccaggggaaaagagtgtgatattatgcccaatatcgcagagggtgtacacttatcctgggatattgtttctagtatttggggagggaggagaggatgctattattctcaatatcgcagaaattgtacacccccgctgtgatattcttcataataatcagggaaaaagaggatgatattactaccaatattgcagggggttacacttcccctttggtagtgttcctaatatccaggaagaaagaggatgatattaatcccattttccaggaagtgtacacccaccgtgtcatgttgttcctaatatccagcagggaagaggatgatattactcccaatatcggagagggtgtacacttcccctgttatattgtttctaatacccagggggaagaaggatgacattactgccaatatcacagggtgtgtaccccaccctgctattgttcctaatattcaaaaggaaagatgaaaatattactcccaatatctcagggtgtgtacacctctcctgtgatatcgttcctaatatccacaggaagagagaatattactctcaatattgcaggggggtgtacacccccctgtgatattgttccaaatattcgggcggggagaggatgatattagtcccaatatcgcagggggtgtgcaccaacctgtgatattgttcctaatatccatgcgggggaggacgatatcactctcaatgtcgcaggaagtgtacacctctcttgttatatttttcttaatatccaggagggaaaagatgatattactgccaatatcgcagggtgtgtccaccccccttttatattgttcctaatatccaatggaaaagaggatgacattgctctccatatcccagaaggtgtacaacgcccctgtaatattgttcctaatattttgggggaagagaggatgatataacttataatatcacaggaggtgtacaccacccctatgtattgttcctaatatcctttaagggagaggatgatattactcccaatatctcaggtggtgcctattccccctgtgatattgtttttaatatccaggggaagagagtatgatattacgcccaatatcgcagggggcatacaccctctctgagatattgttcataatatatagagggagagaggatgatattacttccaatatcagaggtggggtacaccccccggttatattattcttgatatccaggaggggagaggttgatattactggatatatagcagggagtgttcacatcttctgtgatactgttcctaatatccagaaaagtagaggatgatattactcccaatatcgcagaacgtgtacacctccctgtgatattgatcctaacattcaaaggggagaggatgatattactcaaaacatcacagggcatgtacactcccctgtgatattgttcctagtatccagaagggagcaagataatattactttcaatatcgcagggggtgtacacccctctttggtatgtttcctaatatccagaaggaaagagggtgctattactttccatattgcaaggggtgtacacccccctgtggtatggttcataatatccagggagggaaagggtgctattattccccatatcgcgaggcatgtacaccctgctgcggtacggttcctaatatccagggggaaagaggatgctattacttcccatatcgcggggtgtgtacacccccgtgtggtatgttttgtaatctccgggaacgaagagggtgttattacccctcatatcgctggaaatgtacactcccctgtggtacggttcacaatatccaggggattgagggtgctattactccccatatcgcggggggagtgcacctccctgtggtatggttcgaaatatccagggtaagagagggtgctattattccccattttgcaggaggcgtacacccctctatggtatgttttgtaatatcccaggtaaggggtgctattgagagaagagagcaaaagaccccccccatattgttctgtattattttatactcagtacctgttttaagaagaaacaaggaagcgaaaccaaaggcaggcagcccggcgccaggcaccagatccaaaaccagacccgaaaccaggcctgggccttcctgaccttagcctgaaagttaaaattcaacccatgacctagcaactgatgttatccatagattccagacattgtatggaaggacattgtgaaatttcttgttctgttctgtttcactctgagtactggtgcatgcagcccttgtcacatacccactagattgctcaatcaatcatggccctttcatgtaaaaaccttagtgttgtgagcccttaaaaaggacagaaattgtgcactcaacaagcttggattttgatactctagtctgctgatgcttccagctgattaaaagccacttccttcactacctcggtgtctgtgggattttgtccgcggctcctcctgctacactgtgactccccttatagagaggggtgtacacccccctttggttcctaatatccagcgggggagtaggtgctattactccccatattgcggggagtgtacacccccttgtagtacggatcgtaaaatcaaggagggagagaaggtgtaattatccccatatcacagggagtgtacacccctttgtggtatagtttgtaatatccacgacgggagagaatgctattactccccatatcgtggagggtgtacaccgccctgtagtatggttcgtaatatccggaaggggagaggttgctattactccccatatggtgggaagtgtacacccccatgtgatatggttcataatatccaggggggtagaggatgatattacccacaatatcatagaaggtgcacacccttttgtgatattgtccataaaatccagaaggggagaggatgatattacttccaatatcacagggggtgtgtagccccatatgatattgtttgtaatatcaaggtagggagaggatgctattccttacaatagctcaaggggtgtaaccttcttgtgatattgtttgtaatatccagaaggggagaagataatttttttattttaaaagtaaactttaatgtcaaaaatgcaaacttgagaagggcagaaagatcaaacagaaggctgccacttcacaattggagggttgcacagtggccgggcagaggcgctcctcactccccagacggtgaggcagccgggcagaggtgctcctcacttccgagatgttgcaggagccgggcagaggtgctcctcacttcccagaacagggggctgccgggcagaggtgctcctcactgcccagacggtttgcaggcctggcagaggcactcctcacttcccaaacggagcagcggcaagccagaggcgctccacacttcccagatggtggggcagccgggcagaggcgatcctcacttctcagagggtagggcggcccagcagaggcgctcctcacttcccacatggtggggcggcaggctagaggcgatcctcacttcccagacggtggtgtggccatgcagaggtgctcctcacttcccagatggtgtggccgccgagctgaggcactcctcacttccctgacagtggggcggctgggcagaggcgctcctcacttcccagacacttggactccgggcagagactctcctcatttcccagatggtggggctgccgggcagaggcgctcctcacttcccagacggttcagaggccgggcagaggcgctctggggagaggataatgttactcccaatatcgcagggggtgcacactccctgtgatattgttccgaatatccagagggggaaaggatgatatagctcccaaaatcgtggggagtgtacacccccctgtgatcttgtttgtaataccaagaagaaaagagaatgctattatttccaatatagcagggggagtacaaccccctgtgatattgttcgtaatatctagggggagagaaaattatattagtcttaatatctcaggggacgttcatccccctgtaatattgttggtaatattcagaatggagaagatgatattgttcttaaaatacaggaaaaaatatgataatattacttccaatatcgaagggggtgtacactctcctgtgatattgttcccaatatccagaatgaaagaggatgctattactcccaatatcccagggagtgtacacccctttgccatattgttcataatatccaggggaagacaggataacattactcccaatatcaccgggggtgtccacccactagtgatatttattgttcatcatatccagaaaaggagaggatgatattactcccaatattgcaggtggtgtacggtccctgtgatattctttgaaatatctagaaaaggagaggatgatatcactccgagtatcacagggggtgtacacccccctgtgatattgttcgtaatatccaggggagaaaaggatgatataattgccaatatttcaggggatgtgcacctccctgtgatattgtttgtaatatccaggggtggagaggatgatattactcaaaataacgtaaacatcctgtgtgtacatcccctgtgatattgtttataatatccaggggggtagaagatgacattacccccaatatcacagagtgtacacacccctgggatactgttcataatatccaggcgggaaagaatgaactacttccaatatcgcaggatatgtacacccccctgtgatatatttcctaatatttatgtgggtaaggatattacccccaatatcacagaaggtgtacatcctctttgtgatattattcctaacatccaggaaaggagagaatgatattactcccagtatcgcagggggtgtacaccacccctgtgatattgttgctaatatccagggggagaggataatattactcccaaaatcacaggggacgtacactcctcctgagatattgttcctaatattcatggggaaaagaatgctactactccaaatacagcagagggtgtacaccatccccgtgatattgttttttatatccaaagggtgaaaggctgatattactcccaatatcgcagggggtgtacaggccccccatgatatcattcttaatatccagggaggcaaagaatgatgttactcccaatattgcaggctgtatacaccccccgtgatattgttcctaatatccagagtaagagaggatgacattgctcccaatattgcaggggttgcacgcacgccctgtgataatattactcccaatatcaacagtgggtgtacactcctcctgtgatattgtttgttatatctaagaaagaagaggatgatattactgtcaatatcacagaaggtgtacagccccttgtgatgttgtttctaatatccagcggtgagaggatggtattactcgcaatattgtagggggtgtccaacggccctgtgatattgtttctcatattcaaaaaggaaaagaataatataactccaaatatcgcagggtgtgtacacttccctgtgatattgatcctaatatccaggaagagagaggatgatattaatcccaatatcacagggggtgtacatcgcttctgtgatattcttcctaatatccagggggggaggggatgctattactcttaaaatcgcagggaacttacactcccactatgatatttttcctaatatccaggaagggagaaaatgatattactcctaatatcacatatcacaatgggtgtacatctccccgtgatattgtttctaatatcaaggatgggagaaaattatattactctcaatatcgcagggggtgtgcacacctcctgtgatattgttcctagtatccagcggaggagatgatattactttaaatattgtagaaggtgtacaacccccctttgatattgttcctaatatccagggggaaaggagatgatattactcctaatatcgcaggggctgtacaaccctatgtgatattgtttcttctaatatccaggggtggagaagataatattactcctaaaatcgaaggggacatacactccccctgtgatatttttcctaatatccagaaggaaagaggatgatattactcctaatattacaagaaatgtatacctgtcctgtgatattgttcctaatatccagaggggtaaatgattatattactcccaatatcgcaggggtgtacaccttccctgagatattgtttctaatatgcagtggaggagaggatggtattactcccaacatcacaggagatgtaaactccccttgtgatattcttcctaatgttcaggacgaaggagggtaatattactcactgtattgcagcagggggtgtagagccccctgtgatattgtttttaatattcaaggttggagaaaataatattccttccaatatcgcatggggtgtacacccttctttttatatagtttctaatatctggggggagaggatgatattactcccaatatcgcagggggattacacccccactgtgatattgtttttaatatccagggtgggagaggataatattactccaaatatcccagggctatacaccctccgtgtgatattgtttctaatatccagaggaagagaagatgatattactcccaatgtcacagggtgtgtacaggccttctttgatattgttcttaatatccatgagggagaggatgatattactcccaatatcgcaaagactgtacaccctttctgtgatattgcttccaatatccagggagggagaggatattacactcaggatcacagggggtgtacaccccaacctgtgatattgtttctaatatctagggaaaatgagggtgatattactatcaatatcacaggaggtgtacactcccttatgatattgttcctaatatccaggagaatgacaggataatattactcccaatatcgcgggtggtgtctccccccactccgtgatattgttcctaatacccagagggggagagaatcatattactcccaatatcgcaggggatgtacacctacatccggcggagtagaagataatattactcacaatatcgcaagaagtgttcaccttccctgttatattgttgctaatatccagggagtgagaagatgatattactttcaatactgagcgtgtacactacccctgtgatattgtttctcatatccagtagaggagaaaatcatgttactcccaatattgcaggggtgaacacctcctttgtgatatttttcctaatatcaggaaagggagagtatgatattacccttaatattgacaggggtgtacacccccctttgatattgttccaatatccaggggggcagaggataatattattcccaatatcgcagagggtgtacaccccccgtgatattgttcctaatatccagagaaataaaaaatagtattatttccaatatcacagggcgtacattttccctgtaattttgttcctaatatctggggggtggggtggcaggataatattactctcaatattggagagggtgtacacccccctgtgatattgttcctaatattcagggtgggagagaatgatgttactcccaatatctcaggagtcgtatacacccccttgtgatattttttctaatatccaggaggcagaggatgatattgctcccaatatcgcagggggtatacacccgagctgtgatattgtttctaatatgcaatatgggggaaggatgattttactttcaatatcgcagggaatgtacactttccttgtgattttgttcctaatatccaggggtggagaagatgctattactatattactcctcatatcgcaggcggtgtacaactccctgtgatatggttcagaatatccagagtgaaaaaggagggtgacattactcccaatatcgggggggtgtacacccctttgtgatgtggttggtaatatccaggggggcagatgagggtgatatcactccccatatcgtggaaggcgtccacttttttgtgatgtggttctttatatcccgaggggagaaggtgatattactccccatatcgcgaagggcatacacccccctgtgatatagctcataatattccggagagtggaggaagatactatgccctatatcgcgggtggcctacaaccccctatggtttggcttataatatccaggggggagagggtaatattgctccccatattgtggagacgtacagccccctgtgatatggtttgtaatatctttggggggcgagggtgatattactccccatatcgcggggagcatacacccccgtgatctggttcatagtatctcaaaggaagaagttgatgtgtacaacttaagggaaaaagttgaagtgaagtgtacacacgccctgtgacgtggttcataatatccaggcgggggagaggagagtgatatttactccccatatcgcgggtgttgtaaactcccctgtgatatagttcataatatccaggggagagaggagggtgatattgctcctcatatcgcgaagggtgtacaaccccctgtgatatggttcataatatccagaagggtagaggacgatgatattactccacatatcttgggaggtgtgatatggttcgtaatatccagcgatgagagaatgatattactccccatatcgcaaaaggtgtgatagggtttgtaatatcctgagggggagagggtgatattaatccctatattgcagaaggactacaccctcccatgacatggtttgtaatatcccagggggtagagtgtgatattactttccatatcacagggggtgtgatatgattcgtaatattcgaagggggagagggtgacactactctccatatcacggggtgtgtgatatggttcttaatatcccaggggttagaggttgatattaccccctttttggggggtgtgtacaccccctgtgatatggttcgtaatatcccgggggagacagggtgacattattccccatatcgaggggatcgtacaccccctgtggtgtggttcataatatccctagggggagatggtgatattactccccatatcagggggcgtgcactcttctgtggtataattagtaatatccagggggcagaggtcgatattcgtttccatatcatgaagggagtacacttccctgtgatatggttcctaatatccaggggggagagggtgatattattccccatattgcggggggacatacaacccctgtgatatggttcataataaccagaaaagaagagggtgatattaatccccgtattgcagagggcatacaccccccctgtgatatggtttgtaatatctaggggaggaaaaggtgatattactttccatattgctgggtgcagacacccctttatgatatggttcataatatccaagttggagagggtgatattacttcccatatcatgggaggtatacccttccctgtgatatggttcgtaatatccagaaggggagagattgatattactccccatattgtggggggcgtacaccttcctgtgatacggtttgtaatatctaggggatatagtgggtgatattactcaccatatcacgggggttgtaacatggtttgtaatatccaggggaggagagggtaatgttactccccatatctcggggcatgtacaccctcctgtgacatggttcgtaatatccaggtcgggagagggtgatattactcctcatattgccgggggtgtgttatggttcataatatcctggggaaggaggctgctatcactctccacatcttgggggatgtacactctcctgtgatatggttcataatatccagggtgggtgagggtaatattactccccatatcgcgggaagtgtacatacccctgtaatattgtttgtaatagaagagagggtgatattactccccacatcgcgggtggtgcccacccccctgtgatatggtttggaatatccagggggatgaggagggtgatattactccccatatctcggtgggagtacatccctctttgatcaagttcataatatccaaaaggaaacaggagagtgatattactccccatatcgccgggggtgtacacgggagggggagtacacccccggcgatatggtctgtaatatccagggaaggagaggagggtgatattactcaccatatcgcaggtggtctacatttacctgtgaaacagtttgtaatatccagggggggaaatgagaatgattttttttttttgagtctcactgtgtcacccaggttggagtgcagtggcacgatcttggctcactgcaacccccgcctcctggactcaagcaattctcctctcccagcctcctgaatagctgggactacaggcgcaccccacaacgtctggctaatttttgtatttttattagagacggggtttcaccatattggccaggctgatctcgaactcctgaccctgtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggttcataatatccagggaggagagggtaatattactccccatattgtggggacgtacaccctcctgtgatatggtttgtaatatcccagaggggagagagtgatattactccccatattgcagggacatacacccccctgtgatatggttcaaaatgtcttttttttttgaaggactggttctttatttcaaaaagacacttgtcaatattcattatcaaaacagttgcactattgatttctctttctcccaatcggccccaagtagaccacatcaaaggagagtacatattaagccaataagctgtaggatgtacacctaacagacctcctagaaaccttaccagaaaatggggacagggtagggaaagaaactttaaaagatcaacaaactgccagcccacggactgcaggggctgtcacagccagatggggtggccagggtgccacaaacccaaagaagcaaagtttcaaaataatataaaatttaaaaagttttgtacataagctattcaagatttctccagcactgactgatacaaagcacaatgagatggcacttgtagagacagcagcttcaaactcagaaaagggtaatgagatgagtttcacatggctaaatcagtggcaaaaacacaatcttctttctttctttctttctttcaaggaggcaagaaaagcaattaagtgctcacctcaacataaggggaacatgatccattctgtaagcagttgggagggggtagagatggaacaaaattttggtctcagaggtcttgccatcttaatttggtcacttctaatgaaaaaaataaaaaatagaaataacattatccaaaggtatcttaaagctgaaaacttgaacagcacattttttgttgttgttgtttggctaactcctcctggaaccacctttctggcttagctagtactttgtacagagcaatgaggcttcccatagtggagtctccctgggctctgtttggctctcagcaaggcaggcctataccttttcctctcctccatggagagaggaatatgcattaaggtgaaaaatcaccttccaaaagtgagaaagggattcgatcgctgcttcagggctgtggtattatatggaatgttttacaaaaggttgctacaaaacaacaaaagaggtaattacaaaatgtgtacatcacaacatactttttaaagacattatgcattgtgctcacattcccttaaatgttgtttccaaaggtgctcagcctctagcccagctggaatctccgggaagaggcggacagtttggtgaaaaagacacagggaaggagcgggcggcggaaggagggggcggcgaaaggagaaagcagccttccagttaaagatcagccctcaattaaaggtcagcttcgggcaggctggcctcaggcggagtctggttcagagggaggagcagcagcagggtgagactgaggcgttctacatctcattcaggtcaagcagagtctggtccagcatcctttgtgtacagaggtgctcccctttggtgcatttcagtttatcttccaagtcatcaattgtcttttccagcttggctaccgatctctcagcaaactcagcatgggtctccgcctcctttattttatcagtaagaatcttgatctcttcctcatatttgtcttctttttgagagtacttttcttcagcagcactcagacacttcaggttctggtccatcagtctaatctgctcatccatctctcggcaaagggattctgccagctcagctcgttcctctgtgcgttccaagtctccttcaatgatcaccaacttacgagccacctcttcatacttcctatctgcctcttctgcaatgtgcttagcttctctgagttggatttcctggagttccatcttttcttcatcttttaaggcccggttttcaataaccttcttacctctctcactctcatcagcagctttttccgcttcttccagcttttgcagggcagtagccaggtgctcctgagcacggtccagctcctcttcaaccagctggatcccacgttcaaggaggccacctcagcctcagcctgttcccgggcccacctttctccctcaacttctcgctggaggcgctcagctcgctcctctgcatcatctgcctgctgctgcagaacctggatcttgcgcttcaccgcctcgatggtggtgatcccagccatggtgcccacccagctactgctagagctccggttcctgcctcctccgatcggcgttgcagcctcctctcacccttacttccgcctcggttcaaaatatcttaagggaaggagttgatattactccccacatcacgggaagtttacatcccctggtgatatggtttgtaatatcccagggtggatagggtgatattactctccatatcgcgaaggagtactcccccctgtgatatggttcataatatccttggggggagagtgtgatattactccccatatcgcgagggccatatactcctttgtgacatggttcgaaatatcccggtgggggagggggtagagggtaatattactccccatacagcgaagagcatacgcccttctgtggcaaggttagtaatacttcagggaaaagagtgcaatattacttttcatattgcagggaacatacactcccctgtgacatggttcgtaatatcccgggggctgagagggtgatatttctccccatatcaccgggggcctacacctgggtgtgatatggctcataatatacagggagggagagggtgatattactccacataccgagtgaggggttacacaccctcgtgacatgttcgaaataccccaaggaggagacaatgatattactttccctgtcgcgggggctacaccctcccagtgatatggttcacaatatcccggggtggagagggtgatattactccctatatcaccggggggtgtacacttccctgggaaatggtttacagtatccccggggggagagggtactattactccccatatcacgttacatatcagggtacacccccacgtgatatggtttgtaacatcccaggaggaagaaaatgatattactccccatatcgcggtggcatacacccctccccgttaaatggttcataatatcttggggtggagagggtgatattactccccatatcacgtggggcatacaccccactatgatatggttcataatatcccggaggggagagggagatattactctccatgtcgcggggggcatatacacccctgtgatatggtttgtgatatcccgggggcggagagggagatattactctccatatcgtggggtcgtacacttttctgtgatatgattcgtaatatccagacggggagagggtgatattacttcccatattgcgggggcgtacacccctctgtgatatggttcataatatcccgaagaaaagagggtgatattactcctcatatcgcggggaacacacaccaccctgtgatatggtttgtaatattcagcgggggagagagtaatattactccctgtatctcggatggcgtacactcccctgtgatatggttcataatatccagaagaaaagagggtgatattactccccatattccagggaatgtacaccaccctttgaatatggttcgtaatatccaggaggggagagggtaatattgctcccaatatcgaaggaggtgttatacggttagtaatatccagagaaggagagggtgacattactccccacatcgtggtgggtgtgcacccacctgtgatatggttcataatattcaggttaagagaggtgatattgctttccatatcgccaagggtgtacactcccgtgaaatacagttcgtaatatccaaaaggggagagggtgatattactcccatatcgtggggggtgtacacccctctgtgatatggttcataatatccagggtggaataaggtggtattactccctgtatctcggggcatgtacatcgcctgtgatatgattcataatatccagaagaagagagggtgatattaatctccatattgctgggggtgtacaaccccctgttgtatggtttgttacactgagttggggagagggttacattactctcaatatcgagtggggcatacacacttatgtgatatggttcataatatcccagggaggagagggtgatattactccccatatcgcgggaggcatacaccccaatgtgatatggtttgtaatatctacatttttttttttgagacgaagtctcgctcttgtcccccaggctggagtatgatggccggatctcggctcactgcaacctcagcctcccgggttcaagcgattctcctgccttggtcccccaagaagttgggattacaggcgcacaccaccacgcccggctactttttgtatttttagtagagaaggggtttcaccatgttggccaggctggtctagaactcctgacctcagatgatccacctgcctcggcctcccaaagtgctgggattacaggcgtgagccactgcacctggcctggtttgtaatatctatgaagggggaaggtgatattactttccatatcacgggaggcgtacaccacgatgtgatatggtttgtaatatccagggggtatactgggtgatattactccccatatcgcggggagtgtatacccttttgtgatatggttcctaatattaagctgaggagaaggtaatattactccccatatcgcaggggtttttatatggttcataatattcaggaagagagagggtgacattactctccatatcacggggtgtgtactcccccatgtgatatggtttgtaatatccagggaaggagaggttaatattactccccatatcgcagggggtgtacacctctctgtggtttgtaatatccaaagggaagaggatgatattatcttcaatatcttggggggatacagtccccagtgatattgttcataatatccagagggggaggggatgatattactcccaatattgcaggtggtgtacaaccccctgtgatattctttataatatagagggggatgatgatattactcccaatatagtaaacaacctgtgtgtacaccccctgtgatattgtttataatatccaagggtggaaaggatgatattactcctcatatcgcagggggtgtatacccctctgtgacattgttcctaatattcaggggaggagaagatgatactactcctcatatcacaggggatgtacacccccctgtgatacttttggtaatatccaggggaggagaaaattatattattccccatgtcacagagggtgtacaccccgctgtgatagtgttcataatatccaggtgaaaagaggatgatattactccgaatatctcaggaagtgtacacccttctgtgatattgttcataatatccaaaggtggagaggaggatactactccccatatcgcagtgggtgtacacccccctgtgatatggttcataatatccaatgtaggagaggatgatattactttccatatcgcggagagtgtacatccccctgttatattgtttgtaatattcagggagaaagaggatactactactccccatatcacacggggtgtatattcccctgtgatatggttcctgatatccaagagatattataatcctctcttggattatgctacctctcatatcgcatggggtgtacacacactttgtgatatcgtttgtcatatccaaggagggagaggattatattaatcccaagatcacggggggtgtacaccctcctgtgatattgtttgtaatattaaggggggagaggataatattactcccaatataattaacaccctgtgtgtactcctccttgtaatattgttcataatatccaatgggggagacgatgatattactttcaatatcgcagaggatgtacatccctttgtaacaatgtttgtaatataaaaggcaagagaggatgatactacttccaaaattgcaggacatgtacaccccccggtgatattgttcctaatatccagtggggaagaggatgatagtagtcccaatatcgcaaagggtgtacacaccccctgggatattgttcctaatataaaaggaggagaggatgctattattcccaatatcacagaaggtgtaaaatcccctgtgatattgttcgtaatattcaggaggggagaggattatattactcccaatatcacagggtgtgtacacagggaggggcaagggccagaagcgggcgggaatccccatgtttgggcggacccagtttctaatggccagcatttgccaatcaaagcttaccagagaactctaaaagccagggctttcctgctagacaagactcatttctggaactgctttaaaaagaaacaaaacttcccaaggaccccttttcctctctgtctgcctaaaataatgttttaaaaactcctaaagcagctgaattcagcccccttcctgggggaatgtatagacggaactcccacctttcccggcatcccaaggccagagtatgtgaaactcctgggtctctatgtgtgtctgagcggctgctctgccaacactccacacagccctgtgtcctggacccaaggcccttatgacctgagctcaagaggggatctcctgatccatgggttgcaaagatccatgggagaagcatggtttctggggcggggtcacacgctcagtcactgtttccctcggatgccggagatggttcctttggctctctgccaatacagggtgaatcatcatccatccctcttttctttgttctcccgggtcaagttgtttgcctagtcagtcccaatgtgagaacctgaatatttcagttgacgcgctgacttcaaaatccccgggcttcgggaggcggagcttgcagtgagccgagatcccgccactgcactccagcctgggcgacagagcgagactccgtctcaaaaaaaaaaaaaaaaaaaaaaaaaaaaaagtccccgggcttttcttttcactcagtggaaggcagctgcttctaattggccatcttggcccgcccccaccacgtgaccttctgtaaaatgcctccactctccaggaacgctctcattatataactttgcctgaaaccaacagcacgctcattgcacatatcatgggctcatttatttcacttataaagaacctggccaaggaagagatagtgcctaaagtggccagtattctgaccgatatgttagaaaaatggtgtgccgaccaattcatgacatgtgtcccaaaactagcaacggaaattgtattcgccgtgttgaggtctctaatccagatgatgctcatctatgtactggaaaaggcagagtcctttcctgacaagctgctgaaactcttcagaaacatctcatatttcctgaagaagatgatgtctggacaagcagcacaggtcgttcagatttaactttctattcatatatccagcacgatattcgcacaattgtcacgaaaccttaccagttgatgagtcctgcacatttcctttaatttcaggaggaagagggtaatccggatgagttttctgacctactctgctgctgtgattaaacaaccaccaggaaattttgacgacactgttctcctgagctcctccctttcctccgggaacaaaacaattgaatttacaaaaataaagtgttatttgactggagtgaggtctcatgtctgcttatgcggtggctcgctgctcagaacagggtgagtctctgggttgtgtgctgaggaggggaggctctcaatctggagaaaacccactgcaggggacacctccatggggtctgagggactgaggatgaggagccggactgggtctagggaaggaggaggtttcagagggtgaaattctggcactaaagcctgggggtgtttgggaacttcctccttccgaagaagtttcagggagggataaagacaaaccctgggctccttgaggggcccttactaatttgagaggactctatcgggaaggagagtgacaatggcctccttgaggactgaggcccctgaataaatgaggcccagatacagtccatgggggatgagaccttcaagggtcacattttggttgggacagaggaaaagtgcagctctgcagccgcagaggaaaacccggcagtgtgaaagcgaccttggaggggccctgtgcgctctgaatgcgtctgagcccccatcccctgtccccgcctctctttctggattcttccagctcggctgtctccgccatcttctgagcgctccaccctgacttattcaagtttcccttctgccttccaagtactccaaaatctttcagatctgtgtccctacccctgtttttagcatgtgttggggctccaggtccctgaaggtttctggcctgaaatccacctccccagcggagtggactgcgttctagagactccacactccgcgaggttcccaggcccctgagggacaaccgagtggcctgcgcacttcagggctccacactcggcaaggtctttcaagcccttggggtccccttcttagttttttccacctttctgggctgcagtcactccataaatgctgggatctgatccccacccccactctcgtttcctcaattctgcgggctacacgctctggcaaggtcctccgggccctggatcccctccctctccctatgcccacgctcctagtcagcccttctggggtccactattttcaggaactaaccgttctcatggagccttgctaaccggaaagctgtgtggaagaaaggctttgaggatagaggtggagatttggctcttccatagtgccactcacccaccccaccatgctgccactgccagacccggacccctgtttcagaacaagtgaccagattcgctcctggacagccctggacactggccttttctctgaaaactactcaccctttctctagtccccacttcatgccagcctcataccctcttccttcccccacgctggcttccgggatcctcctctgctcagacaacctcttctgtgtcccacccccgtttttagaatgctttggggcaccaggttgggggaaggtttctggcctgatatccatctctttccaaactcccttcttcccttgaaaggcttcttgccttcagccccacttctggctccgaggtttcaggacaccctcctcttcatcctcattcttttgaccaccagctttttaggaattcgaacgtccctctcatcttcgtgaatcctgtccaggcatttgttgaccccttcatctgatacccctgacctcacattgccaaaagtctacccctacccagtacactggaattagacaaaatcccaggagttttacctcaactctgagtgtgcccacaggagctctccctgaagccacgtccttttaagcagggtctagggttcctcccttgtcttaatgaactctttgtcacacggaggacgttatggagcccttatgatctttcactgcctttctgcccagcgttttgtctttccatggacatttataatattttccatggacattttgttctctcaatgtccacccctaatttccaacatcccaaagattctcatgtgtttcctgaaagccatttacaggaatggctgtgcccagacccccttccccaggatcctccttcacacctggtaggtgcctctcctagagagatttgcactcagttgtcgtgcagtcacatggcccagatggttgttaatcacccccttcctggcaacagctagcagccagggaatcactggcacagaaacctcagggtgaccaagatgaggccacctctgtgctgaaggctgtgctccagagcctgcttgggatcaggcttaagcaggtcttcagccagacctgatgttacctggtttccttgagctgccctgcctgagctatcgggagcactccctcaatgcacatcttgattccctatctcatgctctgcttctagaaaccatgagctatcaattgctactggcaatggtcctgggaagtcaaccctaagtatggattctggggttggatgactccccacaggacttcagtgagcaacaatcactgctggcagttggaggacagagtcgctagggcatgtgaccactgtgaaaccaccgatgtttcacctggggtaattttggatgaactacggtagaagcactgaaggtacattgcttttggtttggaagattgtaggtaaataatagcgatatgaatgtggaattggatggctgcaaacgagtgccattgatgcattgaaagaggaaaagtcaggctgtcacctgtcactcagcaatttaaagtgtgagagttgggactagatgtggtggctcacatctataatccagagattcgggggaagcttgaagaggtaggatcttttgagtccaggagttccagaccagcctggacaccagagcaagacctcatctctacaacaaaattttcttaaaaattagatgggcttggtggcacgcacctgtacttgtagatctagctaatggggagcatgagataaaaaaatcacctgagtcagggacttaggggttacaatgaggtatgattgtgccagtgcacacactcccacctggccaacagagtgagattctgcttccaaaaaaataagaaataaatcaggtttgagagttggaaagcatcatcttctcctagagccaaaggacatgtacaactgagacccaggaacaaagcttcatcacaaagagaccatcatcagtggagccgggagatgcattccccctcaccctgccttgaggaggcagtggagtcatctgtctgggatcctttctgacccagccctatttgtttgtctctttggcttctttggatttgtatattttagctgttataacactgtaaaacaaacagagtgatttttttgagttgtgtgaatgatgctagctccatagtcaccctgagagtgatgggaacttttgaatttgtggcaagttggagggtagtgtaagtgacctgagattgccaaattggggctagcactggatgtgaggttaggctagtggaaaaatatgcccagaaccagaggagtgtgggctcactgcaggtggttaggctcagatccaaattgtacagatggatagctttggggtaaagaataacatagttgagaagtgcatgtgttagtctgttcatgcactgctataaagaattacctgagactgggtaattatttataaaactcaggtttaattgggtcatggttccacaggctgtacaaaaagtatgatgctggccatcagctcaacttctggggaggccccagaatagttagagtcatggcaaaaagtacaagggaagcaggctcatcttccacggccagagctggagcaagtggtaggagaggtgatacacactttcaaacaagtaggtcttttgagaactccatcaccggacagcacctatgggatggtgctaaattattcatgaaatatccgcctccataatccactcaactgtcaccagcgcagccagccccacctccaacagtggggattacaattccatatgaggtgtgggtggggacacagctccaacctcaatcagtgggcatcctggattgggtctactatagaaggagaaccaggagctgactatgatcttgaaccctacccatgatggccgggcggggtgactcatgcctgtaaccccagcactttgggaggctgaggtgggtggatcgcctgaagtcaggagttagagaccagcctggccaacatggtgaaaacctgtctctactaaaaatacaaaaaattagaccggcgttgtgctggatgcctgtaatcacaccactacgctccagcatgggaaaaaataccaaaacttcgtctcaaaaaaaaaaaaaaaaaaaaaaaaaaaaagactgcccatgaccactgcaccagtgagagggacaccagcatcactgagatgcaagggctggacattcttcataggtcagagctcaaagcaggggacactgatacagagatgggctccatccatagcaccaaagtggtgagaggatgtgggaatggcagaggccagcactttgccatcaatgcaagggggtataaggaggtgacaccagtgccagagtacatcacggggggactgccctacaatatctaggacttacctcttagagcgtgtttcattagcgacaacagatataaatggcagacaggtgtgtccctgcattaacaggaaatagaaatcatcaagaggaacagaaggcagatgtcagcagccccttagaaagtcatcatccttcatacagttaaaatctgagacagttctcacacgagaaggcctaactcaaaaagaggctgggttctcatgaggcaggtttatgcaaaaccaaggaaggtgtacaagtttggaattctccagtttcccttggaaaagacctacagtcatttgcttaggtaactgagcactgaacaaaggtgagtattgttgtcttttagaagctcttggccaagaaggccttgttggcataaaacccatggtttggaaacatcaccatgacccctgttagagtaatggcctaagggtgggggtcaggaaattgatgtattccttgccaacttctgcctctaagtgagtgaactctgtttgtgaacctctctcctctgtggttatgttcctaggctctcatgtataatcaggagtcatagacttagaaacaggaaaaatacttacagtgtttttgtggcctgtgagctatgacttataattttaggaaaaaaacaattgcaaatggaaagcctaagtctatcaatgctcatccaagacaacataatcaataaaaaccaatatcaaatctcaaggcaaattatttcctgtatatagatggcagagatgagcaccaccatcaaaaactcaaggaccagtgctgtgggtccagtcatctgtttcatggaattcaccagtctggtatcttcaaaatccagaaggatgatggcagatggcaggaaagtaatgcaaacgtcatcaggtgtgaccccactgtagcagctgtgatggatgttttctctcaccatagcaataaataacacaacctcggtcacactgtatgcattgttggtctgcaaaatccatgttttgcaaaactcttcaggaaggtggatctgtaatattggcattgacatgagaacaacagcagtatttattcacaatctcaagctctctgtcttcccgtctctctcattagccatccaagtagtcctgaggaaccaagcccatcagaacattctgcaacataatacacagctccattctccattcaaattttgttgttgttgttgttgttgatgagacaacatcttactccatcagccaggctgacgtacagtggggctatctgggctgactgtagtcttgagcttccaggctcaaggcatcctctcacctcagcctcctaagtggcttgaactacagacacacagcgacatgctgggctagtttttgtatattttgtagagacgtgctctcaccatgttattcaggctggactcaaactcctgagcgtaagtgatccaagcaccttggcctcaaagtgctgagattacaagcctgagccactgcacccagcccaatctccattctactgataacaatgtcattaccaggtctgatggacaggaaatggtaaggtttctgaaaacctaaggatcacacagcgagttccaaaggctgaaagtgcatacctgtcgacactgataccaatgacatccaatggtgagaatgacattccttgtagtcctagctctgctcataacaaatctatactgaagtgtaagagtttgatggtcatggggattttccatgtctctgcctttcagcgatgtgccatatctgtgaagtgttcagaaatgcaacagcctgaggcatgctgggcatatcctctaataaaaaggaaaatgccattttatggtcctgtatttctacaagttggaacacatgggcctgtgatccagatgggggaaatgggaatattcccactcattcaccttcatccacgaagcccatttgaaagctttgggcttcccatccttgtagattttagtgttgtgggctgggtgcagtggctttcacctgtactgccaacactttgggaggcctagacaggtgaatccactgaggccaaaagttcgagaccagcctggccaagatggtgaaaccccgtccctactaaaaatacaaaaattagcaaggtattggggccagcacctgtaatcccagctgctcgggaggctgaggctggagaatcgcttgaacccaaaaggcagagactgcagtgacccgatcctgcctttgcactccacctgggcaagcagaacaaaacttctgtcttgaaaaaaaaaacaaaaaacgaacaaaaaagatgttagagttctgggtttagaggtctataccccagaaagagaatggtttcaacaagggacaaagaagttgctttaaacgttgacttgccatttcttttcagtgtgtttgttctcttgcgtcaagagaccaccagaaaagtggtgcaattactctcctgtcaagaatcattgactatcatctgcaagagggtcagatcctggtatataattagggcagaaatacttagtctgagaagggtatgacatccagaggccctattaatgatgtccttttctccatgcctgactctgaccccatgtgctggactgcccctgtgtggatggcctcatggcctgctcggactctgaggtcccaccccaagtggcacctccatggagggctctactcttgtatgggctctgacactcacactgagacactctcccatggacacctcttcacccacttggggtctgaaactgggctactccatccctccctaacctggaacagagagctttcactgctattacacaagtcatagaggctaactcctcatttttccaagctaattattgaaacattagtcctgggttgataagacaagataagttaacttttcataaatttgcttatcaagttttgaataaattcaaataaattcaccttccccacacaccttagttgtcgacatcacacgcgcacccatactcacagggtgagcacgaaggcttcactgtcagtggagaaagtggcaaaacccttctgtgcctcatcctggtctagacctggccctcatcctttcccactcttcccctcactcccttggattcatccacactggcctcctgcctgctgctccacctccctgcgaagctcacccctgcctcagggcctttgcacgtgcagtggcttcaagccatatcctcttcacccagatctcccagatctcctgaatgatcttcttttatcattcaggtctcagcttgcatgtaatcttctcagtgaggattacccaaaccacatagttcattcattcattcaaatattcattcaatggcatattgacaaagcagctacttcatgccaggccttgggccaggtgttatggatatggcaacaaacaaaacaagagttttctgctctcaaatttttacccacttaaaggagatatcatacatcatctgtaaataaatacatcatctgtaaataatgatgtaaataaatacatcatctgtaaatctgtaaataatgatgtaaataaatacatcatctgtaaataaataaagtataataaaagaaaatagtaggtttttttggttggaggtgaccgtgaagtttgcaaataccatcttacaacacattattttattttatttcatttcatttttaattttattattattatactttaagttttagggtacatgtgcacaacgtgcagatttgttacatatgtatacatgtgtgaagttggtgtgctgcacccattaactcgtcatttagcattaggtatatctcctaatgctatccttcccccctcccccaccccacaacagtccccggtgtgtgatgttccccttcctgtgtccatgtgttctcattgttcagttcccccctatgagtgagaacatgcggtatttggttttttgtccttgtgatagtttgctgagaatgatggtttccagcttcatccatgtccctacaaaggacacgaactcatcattttttatggctgcatagtattccatggtgtatatgtgccacattttcttcatccagtctatcattgttggatatttgggttggttccaagtctttgctattgtgaagagtgccgcaataaacatacgtgtgcgtgtgtctttatagcagcatgatttataatcctttgggtatatacccagtaatgggatggctgggtcaaatggtatttctagctctagatcactgaggaatcgccacactgacttccacagtggttgaactagtttacagtcccaccaacagtgtaaaagtgttcctatttctccacatcctctccagcacctgttgtttcctgactttttaatgatcgccattctaactggtgtgagatggtatctcactgtggctttgatttgcatttctctgatggccagtgatgatgagcatttcttcatgtgttttttggctgcataaatgtcttcttttgagaaatgtctgttcatatccttcacccactttttgatggggttgtttgtttttttcttgtaaatttgtttgagttcattgtagattctggatattagccctttgtcagatgagtaggttgtgaaaattttctcccattctgcaggttacctgttcactctgatggtagtttcttttgctgtgcagaagctctttagtttaattagatcccatttgtcaattttggcttttgttgccattgcttttggtgttttagacatgaagtccttgcccgtgcctatgacctgaatggaaatgcctgggttttcttctagggtttttatggtttgaggtctaacatgtaagtctttaatccatcttgaattaatttttgtataaggtgtaaggaagggatccagtttcacctttctacatatggctagcctgttttcccagaaccatttattaaatagggaatcctttccccacttcttgtttttgtcaggtgtgtcaaagatcagatagttgtagatatgtgacattatttctgaggactctgttctgttgcattggtctatatctctgttttggtaccagtaccatgctgttttggttactgtagccttgtagtatagtttgaagtcaggtagcatgatgcctccagctttgctcttttggcttaggattgactttgcaatgcggggtcttttttggttccatgtgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggttttagttctccttgaagaggtccttcacatcccttgtaagttgggttcctaggtattttattccctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaattattgagagttttcagcatgaagggttgttgaattttgtcaaaggccttttctgcatctattgagataatcatgtggtttttgtctttgggtctgtttatatgctggattacatttattgatttgcatatattgaaccagccttgcatcccagggatgaagcccacttgatcatggtggataagctttttgatgtgctgctggattcggtttgccagtattttactgaggacttttgcatcaatgttcatcaaggatattggtctaaaattctcttttttggttgtgtctctgcctggctttggtatcaggatgatgctggcctcataaaatgagttagggaggattccctctttttctattgattggaatagtttcaggaggaatggtaccagttcctccttgtacctctggtagaattgggctgtgaatccatctggtcctggactgtttttggttggtaagctattgattattgccacaatttcagatcctgttattgctctattcagagattcaacttcttcctggtttagtcttgggaaggtgtatgtgtccaggaatttatccatttcttctagattttctagtttatttgcgtagaggtgtttgtagtattctctgatggtagtttgtatttctgtgggatcagtggtgatatcacctttatcattttttattgcatctatttgattcttctctctttttttctttattagtcttgctaccggtctatcaattttgttgatccttttaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgttataaatttccctctacacactgctttgaatgtgtcccagagattgtggtatgttgtgtcttttttctcgttggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaagtatgtggtcaattttggaataggtgtggtgtgatgctgaaaaaaatgtatattctgttgatttggggtggagagttctgtagatgtctattaggtccgcttggtgcagagctgagttcaaatcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttttttgtctcttacgatatttgttggtttaaagcctgttttatcagagactaggattgcaacacctgcctttttttgttttccattttcttggtagatcttcctccatccctttattttgagcttatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgctcattggttgatgcggtttcttcctagccttgatggtctttacaatttggcatgtttttgcagtggctggtactgactgttcctttccatgtttagcgcttccttcaggagctcttttagggcaggtctggtggtgacaaaatccctcagcatttgcttgtctgtaaaggattttatttctccttcacttatgaagcttagtttggctggatatgaaattctgggttgaaaattcttttctttaagaatgttgaatattggcccccactgtcttctggcttctagagtttctgccaagagatcagccgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttgcagaagttctcctgggtaatatcctgaagagtgttttccagcttggttccattctccccatcactttcaggtacactaatcaaacgtagatttaatcttttcacatagttccatatttcttggaggctttgtttgtttctttttactctctttcctctaaacttctcttctcacttcatttcattaatttgatcttcattcacttatatactttcttccacttcatcaaatcggctactgaaggtattgcatgcatcatgtagttctcatgccatggttttcagctctatcaggtcatttaaggtcttctgtacattgttttctctacttagccattcgtctaatcttttttcaaggtttttagcttccttgtgatgggtttgaacatcccctttagctcagagatgtttgttattactgaccttctgaagcctgcttctgtcaacttgtcaaagtcattctccatccagctttgttccattgctggtgaggagctgcgatcctttggaggagaagaggtgctctggtttatagaattttcagcttttctgctctggtttctccccatctttgtggttttatctacctttggtctttgataatggtgacctagagatggggttttggtgtggatgtcctttttgttgatgttgatgctgttcctttctgtttgttagttttccttcgaacagtcaggttcctcagctgcaggtctgttggagtttgccggaggtccactccagaccctgtttgcctgggtatcaccagcggaggctgcagaatagcaaatattgcacaacagcaaatattgctgcctgatccttcctctggaagcttcgtctcaaaggggtgcctggctgtatgaggtgtcagttggcccctactgggaggtgtctcccagttaggctagatgggggttagggacccacttgagaaggcagcctgtccattcacagagctcaaacactatgctaggagagccactgctctcttcagtgctgtcagatggggatgtttaagtctgcagaaatttctgctgccttttattcagctatgccctgcccctacagatggagtctacagaggcaggcaggcctcattgagctgcggtgggctcctcccagttcgagcttccagaccactttgtttacctactgaagcctcagaaatggtgaacacccctcccccacccagtctgccgccttgcagttccatctcagactgctgtgctagcagtgagcgaggctccatgggcgtgggacccactgagccaggcacaggatataatctcctggtgtgccatttgctaagaccattggaaaagcacagtattaaggtgggagtgtcccaattttcccagtacagtctgtcacgggttccctcatctaggaaaggtaaatcccctaaccccttgtgcttcccggtgacgcaatgccccaccctgcttcagctagccctccatgggctgcatccactgtccaaccagcccaatgagatgaacaaggtacctcagttggaaatgcagaaatcacccatcttctgtgtggatcaggctgggagctgcagaccggagttgctcctattcggccatcttggaatggcaatctatgtttgctttttacatttgaaaaaactggtgtcacgtacctaggtattaatcattgtggtatcctcttgccgatttacctctttatcattaactagtgaccctccttgtcttttgttgttacagtctgtgattttagtctattttatctaatatgagaatagctactctggcacttttttggtttccagcttcatgaaatatccttttccatttccctgttttcatttccctttcggtgtctctatagatgaagttgatttctttaaggcaccataagttgggtcttatttctttatccatttgaccatttagagaatttagaacactgtcagtgttattattcataagtaaaaacttaagagtgggtgtagtggtgtacatctgtatttcctgcactttgagagactgaggcgagctgatctcctggggtcaggagtttgagaccggcctggtcaacatgatgaaaccctgtctctactaaaaatacaaaaattagccaagcatgctggcatgtgcctgtaatccaatttacttgggaggctgaggcaggagaagcttgaacctgggagacaaatgttgcagtgagctgagatcacacagagaagtcatctccactctcctcatcagaacctcttgttcacagcatttgtgagcacaaatcaatgatggttattctttcctactaattagggatattttattacacagcaatagcctccagcaaagggaaccatcatacatgattcctacaagttgacagggctggaattatcactgaaaaactaaggtggctatacttgattcccaatgtccaatttttcatgaatagagaaatttatcctttttccccccagccagaaaccaagttttgctcttacgcccaggctggaatcaagtggcacaatctcagctcactgcaacctctgccccccagcttcaagaaattcaccttttgaacaaggagatattaaggatacactatgtgtatgctaccggtggttgcaggagactcagaaaagagagaaacagtcactggcctcgtgcaactgatattctcgggaggagagaaaggcaatcaagaaagaaacatgctgtatttcagacagctgtaagtcctccacaagaaaagaaagcaggtgaggaacataggaaatgtgtcaaccataaggttcccgctaattctataagttggtcagggatatcctccaagaataagcagcatctgagcaatcacctgaagggaggaaggaaggaagactgtgagtggtggcttacacctgtaatcccagcactttgggaggccaaggagggcagattgcctgagctcaggagttcacgaccactcagagcaacctgttgatacccaatctctactaaaaacacacaaaaaaattacccgggtgtggtggcacgcacctgtagtcccagcttccatgcccagctgatttctctctctccatatatatatatatatacacatatattgtttttgcagagatagggtctcactgtgtcacccagtcatcaagcaattctcttatactgttttggaaaagcatgggaattacaggtgtgaaataccctgctggtcctgaaaaatgtgatatttgggattctctgcctggcttgttttacccaaaataatgacctccagttccttccaggttgctgcaaaagacatgattttcactgttttataactgaatagtattcctgtatgtatacataccacattttctttatttattcttctgttgattgacatgtagggtgattccatgtctttgctactgtaaataatgctgcagcaaatatttgtgtgcattttgatctattcctttgagtaggtacccagtactgcaactgcaggactgagtagttgttatattttttgttctttcagaaatctccatagtgtttgccataaaatctgcactaatttacattcccaacaacaatgcataagatttccccttttctccacattctcactaacatttgttatgtttttgtctttttcataatacccattctgactggagtaagatatctcattgtggtggttgttgatatttttgagacggggtctcactctgttgccagactggagtgcagtggtgtgatcgtggcttgctgcaacctccacctcccgggttcaagcaattctcctgcctcagcctcccgagtagctgggactacaggcgcgtgccaacaggcctggctcattttttgtatttttagtaaagacagggtttcaccatgttggccaggatgatcacagtctcttgagctcatcatacacctgcctcagcctcccaaagtgttggaattacagtcatgaggcagcgcacccaacctcaatgtggttttaatgaccatttctctgacgattcatggtgtggagaatttctttgaaataccttttggccatttatatgtgctcttttaaaaactgactcctgtccaggtgcggttgagcatgcctgtaaccccagaacttcgggaggctgaggccaatggatcacttgaggcaaagaggcagaaatcagcctggccaacaaggcaaaaccccatctttactaaaaatacaaaaaatcagccacgggctgtgactcgtgcctgtggtgcaagttactcaggaggttaaggcacaggaattgcttgaacccggtaggcacaggtcacagtgagccaagatcatggcactgcactacagcatgggtaatagagaaagacctgtctcataaaaacaaatgaataaataaataagataaaaaataaaaaagtctctttatgtcctttgccgactttttaatgggattctttggagttttctgttgtagttgagatctttgtttactctcggtattagtcttttgtcaaaggaaaagtttacaaataatttcttccgttctgcagtttgtctgctcactctgttgagaggattatttctttggctgtgcagcagctttttgtttcagtaaagcttttgaatttatataattaaaattttcagtttggtttaaatttgcactggtcgatttttggttttgttgcctgtacttttgaagtcatactcttgaactctttactagacaataaccagaagagttttctctagttttcttctcacatttttattatttcagtacatatatttaagtctataattcatcttcaattgatttttgtagaaatagtgagaaataggagtccaggtttattcttctgcaaatgacaattcaattgttccagcaccaattattgaaaagggtgtgctttcctcaacgtatattcttatcagctttgtcaaagatcagttggctataaatgtgtggctttctttctgggctctctagtctgttacatcaatctgtgtgtctatctgtatactactaccatgctgtattggtgatgatggctttgtaatataatttgaagtcaagaaatgtgatgctcccagctttgtttatttgcttcagaaaggctgagtcaacagctgcagagatgaagctgcccctcctcgcagggctccttcccggaaaaagatcatggctcccactgaccatataaccatggctggaactcctgaaattcccaaagggaggccctacccagtgaggggggatgaatgaaggtcctacttaaggaatctgtctggccacaatcaggcacagcagctgtgctgccttgtgggggaccagaccacctggattccctggagcctgcaggctagaatgtctgagtccatggaaacacagaaatggaggccgccctcacctccccagaaaactgtagtctcaggcagtctccagccgattgccactggttggctgctattccaagccagtgggtcttaacttgagaggtgctgtggaagtggggcccacggaatgaggctgcttggctccctggattcagccccttttctaagggaatgtacagatggaactcccgccttgcccagctttccaagtatataaaactcctgagtctctgtgagtgtctgagcgagtgctctggcaacattcgacacggctctgtgtatctgacccaagacccttatggcatgagctaatgggaggatcttctgatccatgcgtggcaaagatgcatgggagaaacatggtttgtgggtaggggttgtgcattcactactgcttctcttggctgtaggtgaaggtttctttggctctgtgctgatactgggtgcaccatcacccaccccctttgtttcttctcctgggtcaagtcatttgcctaatcagtcccaatgtaggaacctggatacttcagttcaaggtgctgaattcaccgtgcttttcattcaggggaagacagctgcttctcattgggcatcttggcctgcccacttcacgtcactttttgtaaaatccacaccactccaggaatatccattacttaacttcgcctgaaataaacagaaggctcattacacttatcatgggctcacttacttcgcctataatgaaggtgccatggaaatgctagtggatgacgtggtccattttcttagggatgagatagaaaaatggtgtatggctttttaatttaattaaaatttttagtttggtttaaatttacattggtctctttttggttttgttgcctgtacttttgaagtcttactcgtgaactctttactggacaatgaccagaagagttttccctaagtttcttctgatattttgaccatttcagtacatacatttcagtctataattcactttaaattgatttttgtaaacatggtaagaaataggagttcagatttattcttccgcatatgataatgcaactgtcccagtaccaattattgaaaagggtgtgctttccctagtgtatattcttgtcagctttgtcaaagatcagttgcctatgaatgtgtggctttcattttggattctctcgtctgttacatcaatctgtgtgtccacatttatacctgtaccatgctgtattggtgactatggctgtgtaatatattttagagttaggaaatgtgatgctcccagctttgttcatttgcttcagctgaaaaggttgagtccacaattacaaagatggcagccgcccatccccggaggacctccaacccagaaagagatcaggcttcccaccaaccctataaccctggctggagttcctgaaattccaacagggaggaccttcccagtgaggagggatgaatcaaggtcaaatttaaagaaacagtctggccactatcaggcacagcagcagtgctgccttgtgggggacccctcctgctccagaccagctgccctccctggagcccgaaggctagattgtctgagtctacggaaacagagacggtggccgccccaaccacccagaactcggtagtctcaggcacttggcttgctatcttgccactgcttggctggtattccaagcccgtgggacttgagaagtgctgtgatgatggggaccacaggatgaggctgtctggctccctgtgatatggctgtgatgagtggaggaacaccagggctcatgtctcacacagaattggagaaaatgacacaaacacatgtacagtggttttatggcgtgcagtttaataggcaagaacgaaggaagagctccccatactgagacagagggaggggggctccaaagccaaaagaggaaacccggagtgctgtggataccaatgagttatatgaagaaactggagggggcggtgtctgatttgcatagggttcaggcgattggttcgaccaggcatgtcatttatgtggcccacggaaaaactggccctcccacctagcctttgaatatgcacgtgccggacaccctgatttcctacactcatggggatatatgggggtggccatatcgccaggcacaggtggggacaagggccagaagagggcgggaatcgctatgtttgggtggacccagtttctaatggccggcatctgcagatcaaggttaccggagaactctaaaagccggggctttcctgctagacaagactcatttctggagctgctttaaaaagaaacaaaacttcccaaggaccccttttcctccctgtctgcccaaaataatttcttaacaactcgtataacacctgaattcagcccccttactgggggaatgtaccaacggaactcccacctttcctggtttctcaaggctagattgtgtaaacctcctgggtctcggtctgtgtctgagcagctgctctgccaacactccacacagccctgtgtactaggcccaaggccgccgtgactcagcccatgggaggatctcctgatttcttggttgcaaagatccatgggagaaaaatggtttctggggcggggtcacacactcatggcttctcttggctgtgcaagaaggttcctttggctctgttccaatatagcgtggttcatcacccacccctgttttctttgttctcctgagtcaagttgtttgcctagtcagtcccaatgtgagaacctgaatatttcagttcacgtgcttatcgtgaaattcactgagactttaattcagtggaaggcagcctcttctaattggccatcttggcccgccccctccacgtcacctcccataaaatggccacgctctccagggacgatgccattatatatctttacgtgaaaccgacagaacacttattacactttttgtgagctcatttacttcacttataatgaacatggccatggaaatgctagtggagaaagtggtcgattttctgatggatgtgataaaaaaatggtttgccgaccaattaatgacatatgtctcaaaactagtaacgagacccttaatcgctgggttgaagtttctaatcaagaagatgctcatctatgtattcaacaaagcagcttcccttgcttctgaaatgcttccaaacaacatctcatatttcctgaagaagataatgcctggacaagcagcacaagtcattcaggtttactttcagctcataaatccagcaggatattcgcacaattgttgggaaaccttatcagttcatgagtcgtgcatgtttcctttaatttcaggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggctggagtgaggtctcatgtctgcttatgcggtggctcgctgctcagaacagggtgagtctctgagttgtacgctgaggaggggaggctgtcaatctagaaaaaacccattgcatgggacacctccatggggtctggggggctgaggatgaggagctggactggatctagggaaggaggaggtttcagagggtgaaattctggcagtaaatcctgggggtgtttgaaaacttcctccctcagaaggagaagactcagggaggaataaggacaaaccatgggtcccttgaggggcatttactaacttaagaggactttatcgggaagcagagtgacaatggcctccttgaggactgaggcccctggataaatgaggcccagatccagatccagtccatgggagatgagaccttcaagggacatatttttgttgggacagaggaaaagtgcagctctgcagctgcagaggaagccttggcagtgtgaaagcgaccttggagggggccctgtgcgttctgaatgcttctgaggtccatcccctgtccccgcctctttttctggattttttgggctccatggtctccgccatcttctgagcgctccacgctgccaccttcagttttctcttctgggctccaaatactccaaaatctttcatatctgtgcccctacccctgtttttagcatgtgttgggactccaggtccctgaaggtttctggcctgaaatccacctccccagcggtgtggattctgctctagagaccccgcacttggcaaggttcccaggcccctgggggacaaccgagtggtatgtgcacttcagggctccacactcggcaaggtctttcaagcccttggggttccctcctcagttttcttcacatgtctgggatgtagtcactctataaatgccgggatgtgatccccaccccagtgattttttttagttccatgagtgttgctatctgaatagtcatcctgagagtgatgggaccttttgaatttgcagcaagttttagattagtgtgagtggcctgagatcgcaaaactggggctagcattggatgtgaggttaggctggtggaaaaatttgcccagaacctgaggagtgtgggctcactgcaggtggttaggatcagcacagaattgcaaggatgtatagctttggggtaaagaataacatggttcagaagtacatgtattagtcttttcatgcattgctataaagaattacctgagactgggtaattaattataaaaactcaggtttaattggctcatggttccacaggctgtacaaaaaggatgatgctggccatcagctcaacttctggggaggcgtcagaaaacttagagtcatggcaaaaagcacaagggaatcaggctcatcctccatggccagagctggagctagtggtaggagaggtgctgcacacttttgaacaatcagatctttttagaactctatcaccagacagcacctagaggatggtgctaaattattcatgaaatatccacccatatgatccactcaattctcaccggcccaaccaggaccacctccaccattggggattacaattacacatgagatgtgggtggggacacagatccaaactcgatcagtgggcatcttggactgggtctactatagaagaagaaccaggagctgactatcatccttaagactgcccatgatggccaggcagggtggctcatgcctgtaatcccagcactttgggaagccaaggtgggtgaatcccctgaggtcaggagtttgagaccagcctcgccaacatggtgaaaccctgcctctactaaaaacacaaaaaattagatgggtgttgtgccagacgcctgtaatcacagctactccagaggctgaggcatgagaattgcttgaacctgggaggcggaggtggcggtgagccccaatcgcactgctacactccagcatgggcaacaataccaaaacatcgtctcaaaaaaaaaaaaaaaaaaaaaaaaggctgcccatgaccactgccccagtgagagggacaccagcatggctaagatcaagtgctggacattcttcatgggtcagacattaaagcaggccacactgttacagagatgggctccattcatagcaacaaagtggtgagaagatgtgggaatggcagaggccagcactttgccatcaatgcaaggtgggcataaggagctggcaccagtgccagagtgcatcaggggaggactgctttgcaatatctagcacttacctcttagagtatgtttcattagggacaacagatataaatggcagacaagtgagtcccttcagtaacaggaaatagaaatcatcaagaggaacagaaacagatgtcagcagccctcatataaagtcatcatccttcatccagttaaaacctgagacagttctcacataagaaggtctaattcaaaaagagactgggttctcatgaggcaggttcatgcaaaaccaagggaagtatacaactttgggattctccagcttcccttggaaaagacctacaatcatttgcttaggtaactgagcactgaacaaaggtgagtattgttatctttcagaagctgttggccatgaaggtcttgctggcataaaacccatggttggaaacatcaccatgacccctgttagagtaatggcctaagggcaagggtcaggaaattgatgtattccttgccaacttctgcgagacgagtgttggtccactcatctctttcacggaattcaccagtctggtatcttcaaaatccagaaggatgatggcagatggcaggaaactaatgcaaacaccatcagttgtacctccactgtagcagcagtaatggatgttatctcttcattgtaatatccagggagggagaagatgacattattctcaatattctaaacaccctgtgtgtacagcctctgtgatattttttgtaatatccgtgtgggagagaattatattactcctaatatctcaggggttgtgccccctctgtgacaatgttcctaacacccaggaggggataggatgatatcacttttagcatcacagggggtgtacaccccactgtaatattgttcataatatccgggggggagagaatgatattactcccaatatcgcaaagactgtacaccaacctgtgatattatttgtaatatccataagaggaagaataatattactcccaatgtcacaggaagtgtacacccttctgtgatattgttcaaaagatccagttagggaggggatgatattactctcaatatcttaaacaccctgtaggtaagccctctgtgatattcctcataatatccagagggagaggatgatattactcccaatattgcatgaagtctacaccccacctgtgatattgttcctaatatccaggatgggagaggatgatattactcccaatgtcgcaggggatgtacaccttccctgtaatattgttcgtaatatctagaaaaggagaggataatattactttcaacatcgcagggggtgtacaccttccttgttatattgttgctaatatccagggaaaaagaagatgacattaccaccactattgcagaaggtgtacacccccccttgatatagttcctaatatccagaaaaggagaggagatattactccaaatattgcaagaggtgtacattcccctgtaatatttttcctaacattcaggaagaaagagagtgatattgcccttaatattgaagggagtgtgccccccccgtgatattgtttctaatatccaagaaatgaaaggatgatattactcccaatatcacaggggctgtacagccccctcccatgatattgttcccaacatcggggggggggtgaaatagtattattcccagtatcacaataggtgtacacacctgtcgtgatattgttcctaatacccatgggggaaaggacgatattattcttaatatctcagagggatgtacaccctccctgtgatattgttcctaatatccggggtgggagaggatgatattacccccaaaatctcaaagggtgtacacccctcttgtgatattgttcctaatatccagggtggagaggataatattattcccaatatccaggaaaggaaacgatgatgttactgtgaatattccagggggtgtcctcccctctgtgatattgttcctaatatccaggttggggagattatgatatttctccaaatatcacaaggggtgtacaccaaccctgtgttattgttcctaatatcgatggggggagaggacgatattactcccaatatcacagggggtgtacaccacctttatgatattgttcctaatatccatgaagaaagaggatgatattactttcaatatcgcaggggatgtacactccccctgtgatattgttagtaatacctaggagaagaaagtgtgatattactcccaatatcgcaggggatgtacacgcttcctgtgatattgttcctaatatttagggggaaaggggatgatattactcccaatatcgaatggtgtgtacacccccccgtgattctttttttttttttttttttttttttgagatggagtcttgctctgccgcccagactggcgtgcaatggcgcaatctcggctcactgcaacatttgcctcccaggttcgcacgattctcctgcctcagccttcggagtagctgggattataggcagctgtcaccataccaggctaatttttgtatttttagtagagttggggtttcaccatgttggtcaggctggtcttgaattcctgacctcaaataatccacccaccttggcctcccaaagtcctgggattacaggcataactttccctgtgatattcttcctaatattcaggaagaaagaggatgatattgctcccaatatcgcagagagtgtgcactcctcctgtgatatggttcttaatattcagaggaggagaggatgatattactttctatattgcagaaggtgtacacctccctcgtgatgtctttcctaatatccagtgggggagaggttattagtctcaaaatcacagaaggtgtaaacccccatttgatattgttcctaatattcaggggtggggagagaaaggtattactcctagtatttcagggcatgaacacccccaccgtgatatcattcctaatatccagaaggggaggcaatgatatttctcctaatatcacaaagggtgtacaccccttctgtgatattgtaaatattctgtgtgtacacccccctgtgttatagtctgtaatatccgggtgggggagagggtgatatttctccccatattgtaggggatgtacacccttctgtgatatggttcgttatatccagggaagaaaaaggtaatattgctgcccatattgtggagagtgtacacccccatgtaatatggttcgtaatatccaggagtggagagggtgatactgctccttacatcgaggaaggtgtacaccttattgttatatgattcgcaatatccaggggaggagagagtgatattgctccccatgtcgcagggggtgtaaaccctccgtgatatgattggtaatatccaggaaaggaaagggtgatatttctccccatatcgcgggggacgtacatcctcctgtgatatggttcgtaatatccaggaggaaagaggaaaatattgctcttcataacccgaggggtgtacaacccctgtgatatggttcgtaatacccagaagtgtacacccctctgtgatatggtttgtaatatccagggggttagagggtgatattgctccccatatcgcagtgggggtacacccccctggattggttcataatattcatggggggagaaatttacatttatcctcatatcagggggggtgtacaccccccgtgatatggttcgtaatatccaggggaagaaagggtgatattgctccttatatcgcggaaggatcaccctcccctgtgatatggttcataatacccagacgggaagagggtgatattgttcttcataaagcgaagggtgtacagccccctgtgatatggttcataatatgcaaaaggggagagggtgatattgctccccatatcacggagggtgtactcccttctttgatatggttcgtaatatccaggggtgtagatggtgatatagctcgccctattggggagggtgttcacccctctgtgatattgttcgtaatgtccagggaaagagaggatgatattactcccaatatcgcagaaggtttacaccactctgtgatattgttcataatatccagggaaggagaagacgatattactcccaatatggcagggggtgtagaactcctgtgatattgtttgtaatatccaggcaaggagaggatattactctcaatatcgcagaaggtttacacccctatgtgatactgttcatgatatccagggaaaaagaggatattactccctatatcacaaagggtgtacacccctttgtgatattttttgtaatatccaggggagagaggataatattactctcaatatcagaaggggtgaaaaccctcctgtgtcattgttcataatatttagggaaggagagagtgatattactccaaatatcacagtgggtgtacacccccctatgatattgttcctaatttccagaaggggagatatgatattattgccaatatcgcagaaggtgtacaccttactctgacattgtttgtaatatccagatggggaaatgatgatattactcctaatatcacagggggtgtacacccccttgttttattgtttgtaatattcaggggaagagacgattatattactcccaatatcgcagggtgtgtacaacactctatgatattgttcataatatccaggggaggagaggaagtgtacacccccccgtgatattgttcgtaatatccagaggtagagaggatgatattactcccaatattgcaggtggtgtacacctttctgtgatattgtcatgatattaagaaggggagaggatgatattactaacaatatcacaaaaactgtacactccctgtgatattgttcataatatccagaagaagggaggatgatattattctgaatctcgcagaagatatacaccaccctgtgatatggttcataatatcctaggggaaagaggatgacataactgtcaatatcgcagggggtgtacaattccctgtgatattgttcacaatattcagagggaaaaaggataatattactttcaatatcgcaggcggtgtacacattactgtgttattgtttataatatccggaatgagagaaaattttctcccaatatcacaggaggtgtacactcccctgtgatattgttcgtaatatccagggaggggagaggatactattactcccaacatctcagggagtgtaggccccccctttgatattgttcctaatattcggaagtggagaagatgatattacttccaaaatcgcagggggtgtacactccctctgtaatattgtttctaatattcatgagtggaaagaaagatattactcccagtattgcaggggacatacaccacactgtgatcttgttcacaatattcgggggggagaggatgatattactcccaatatcaaagtaggtgtacacccccttctgatattgatcgtaatatccagaattaaagatgataacgttactcccaatattgcagggggtgtacatttttgaatactgttcataatattaagagggggaggggatgatatctgtcccaatatcgcaaagtgtgtacacctcctgtgacattgtcccaaatatccagaggaaaaaaggatgttattactcttaatatctcagagagtgtacacctccctgtgatattgtttgtaacatccagaagaaagaggctgatattactcttaatatcgcagggggtgtacacccccgccccgggatattattcgtaatatccagggggaagtggaatgttcagaatgggagaggatgatattacttgcaatatcatagtgggtgtacaccccactgtgatattgtttgtaatatccgggaaaggagaaaatgacattcctccccatatggcaggggctgtacaccacctatcatattgttcaaaatatccagaaggggagaggatatgtctccaagtatcacagggggtgtacaccccgctgtaatattcttcctaatatccagggtgtgagaggataatagtactcccaatatcccagggcatgtacaccccccttgtgatgttgttcctaaaattcatggggagaaagaatattactcccaatatcacagggggtgtacatacactctgtaatattgttgccaatatgcagcaggagagaggatgatattactcccaatatcacaggggctgtacaccccgctgggatattgtttctaatatcaagggggaaaaaggatgatattactcccaatgtcgcagggtgtgtacttcctctttgtgacattgttcctaatatccaggagagaagagggtgacattccttccaaaactgaaaggggtgtacacaccctttgagatattgtctttaatatccagaacgaaacaggatgatataactcctaatactgcaggggggtacaccctctctgtgatactgtttctaatatccaggaggggaaagaaaaatattaatcccaatatcacagggggtgtacattccccctttaatattgttcctaatatccaggaagacacaggatgatactatttccagcagcacagggcatgtacacccctttgtgatattgttcctaatatccaggaaaagagaggatgatattactgtcaatattgcagggcgtatacactggttctgtgatattgtttctaatatccgggggtggagaaaatgatattactcccaatattccagcgggtgtacacccgttctatgatattgttcctaatatctgggggagagagaatgatattattgtcaatatcacaggggatgtacagattccctgtgatattgtttctaatattcacagggggagaagggtataatactcccgatatcgcagggggtgtacactccccctgtgaagttgttcctaatatccagggattgagagaatgatattactcccaatatcacaggcggtgtaaaccccctgtgtgatattgttcctaacatccagaggaaaagatgatgatattattttcaatatcacagggggtgtacgcatccctgtgatattgtttctaatatccaggggaggagaggatgatattattgttaatatcgcagggggtgtaccccaccctgtgatactgttcctaatatccggggtggaagaggataatattgctcccaatatcgcaaagggtgtacaaccttcctgagatattggtcctaatatccagggagggagaggatgatattactttcaatatcacagggagtttacacaacccctgcgatattgttcctaatatccagcggaagaagagttaggataatactattttcaaaattgctgggtctgtaccccctccccgtgatattgtttctaatatccaggaggggagaaagtaatatgactcccaatatcttagaagatgtacaccctccccataatattatttcttacatccagggggtagaggatgattttgctttcaatatcacagagggagtaaacctttccggtgatattgtttttaatatttaaaaagagagaagataaaattactcccaatacaaaggggatgtattgtgtactcccccctctgatattcttttttaatatccagatggagagaggatgatattactttcaatattgcatgggatgtataaatcccctgtgttattgttctgaatatacaggtggggagagtatgatattactccaaatatcgcagggggttctttccccctgtgatattgttcctaacattcagggagggagaggatgatattactcttaatattgcagggggtgtacccacgcctatgatattgttcctaatatccagagggggagaggatgatctaactcagaatatgacaaggggtgtacacacagcctgtgatatggttcctaatatacaggggagaaggggataatatttctcccaatatcgcagggggtgtacaaccccctgtgatactgttcctaatatacagaaggggacagcatgatattgttcctaatatcgcaggaggtgtacaacgccctgtgatattgttcctaatatccagggcgggagaggatgatattaccctcaatatcgcagggggtgtgcactttccctgttatattgttcctatgatccgggtggggggaaatgacattagtcccaatatcgcaggatgtgtgcaccgctcccccgtgatattgttcctaatatcaagggggagagaggaggatattactcccaatatcgcaagggatgtacatcctccatgcgatattgttcgtaatattcaggaggagagaggatgatattactcttaatatcgcagaaagtggacacccaccctgtgatgttcttcataatatccagggaagcagacgattatatgactttcaatatcgctgggagtgtacatcccttttgggatattgtttctaatatccaggaagggagaggattatattactctcagtattgcaggcagtgtacaccttttttgtgatattgttcctaatattcagaaagggaaaggatgatattactcccaatattgcaggtggtgtatatccccctctgatattgttccttatatcaaggaagagaaagaataatattactcccaatatcaaagacagtgtagacccctcctgtgatattgtatttaatatccatggggaaagaggatgatgttactcccaatatcgcagggggtttacacccacactgtgatattattcctaaaatccagtggaggagaaaataatattgctcccaatattgcagggtgtatacaggccctcccccgttatattgctcctaatatccagcggtggagaggatattactttcaatttgtgtagggagtgtatacccccctgtgatatttttctaatatcaaggatgggaaaggatgacattactcccaatatcgcaggaggtgtacacgccctgtgatattgttcctaatatctagggaaggagaggatgatattactttcaatattgcaggagctgtacaccctctgtggtattgttcttaatatttaggttgggagaaaatgatatgagtccaaatatcgcagaaggcatacacacttccaataacattgttcttaatatccgggggagagggtgatattactcccaaaatctctggggggtgtacacccccttctgatatttttcctaatatccagggaaggaaacgatgatattactataaatattccaaggagtgtacaccttcctaatatcctaatattgttcctaatatccaggggtgggagaggattatattactcccgatatcgcagtgggtgtacacccctcctgtgatattgtttctaatatccaagctaggagaaaatgatatcactctcaataccacagggggtgtacaccttccgcatcatattgttcctaatattcagagggaaagaagatgaagttactttcaatatcggaggggttgtacacaacccctgtgatattgctgctagtatccaggaagaaaggggattatgttactccccttatagcagggggtatacacctcccctgtaatattgttcctaatatcaaggctgggatatacgtggggggaaggatgatattactcccaatatcgcaggggttatacaaccttctgtgatattgctcctagtaaccagggcagaagaagatgatattactcctaatatcgcaggaggtgtacactcccccattatgttgttcccaatatgcagaaaaggagaggatgacattattgccagtatcgcagggtgtgtacaccacccctgtaatattgttccaaatatttagggggagagaggatgatattactcccaacatcgcagggggtgtacacacatcccctgtaatatagttcttaaaatctaggggaaaaggggatcttatttctctaaatattgcagagggtgtacactccccggtgatattgttcctaatagccgggagggagataattaaattactttcaatatctcagagagtgtacatcgcccttgcgatattgttcctaatatccagagcaaaagagaatgatattactcccaatatcttaggagtgtacatttaacctgtaatattgttcctaatatccagggggaagagaatagtattactgccaatatcgtaggggttgtacaccttttctgtgatattgttgcaaatatttagtagagggaaagaatattactcgcaatatcacagggaatgtatacttcccctgtgatattgttctgatatccagaaaaagagagggtaatattactcccaatattgcagggggtgtacaccccccttgtgatattgatcctaatataaaggaaggaagaggatattactcctcatatagaaggggttgtccaccccccttgtgatattattcctaatattcagggaagcagaggatgatattattttcaatatcacagagggtgtgcagtccacctgtgatattgttcttaatattcggggggagaggatgttattatgcctgatatcgcagtagaggtacacccctcaagtgatactgttcctaataaccaggggtgaagaggatgatattactcccaatatcgcaggtggtgtacacccccccatgatggtttctaatatacagagggggagaggaaaatattactcccaaaatcgctggaggtctacaccccccttgtgatattgttcctaatatccaggaaaggaaacgatgatattactgtgaatattccagggggtgtacacccgctttgtaatattgttcctcatatccagggtgtggagaggattatattactcccagtatcgcagggggtgcacgacgcccctgtgatattgtttttcatatccaggaggggagattattatcaatatggcaaggggtgaacaccccctgtgatattgtacttaatagttaggttggcagaaaatgatattagtctcgatatcgcagggggtgtgcactccgcctggtgatattgcttttaatatcaagggggagaaaatggcattactcccaatatcgcagggggtgtacaccgctcatgtgatattgttcctaatatccaggtggagagaacataatattactcccaatatcgcacaaggtgtacacccctcctgtgatatggttcctaatatccatgggaggagatgatgatattactcccaatatcacaggggatgtacaccacccttgtgatattgttcctaatatccagggaagaaaacgatgatattattgtgaatattacagggagtgtacacactccctgtgatattgtttttgatatacagggtgggagaggatgatattactcccaatatcacataaggtgtacaccccccgtgatattgttctaaatatttcggtggggagaaaatgatattagtctccatatcacagggggtgtgtgctcctcaggtgatattgtttttaatatcaagagggggaggagattatattactttcattatcacagggggtgtacacccctcctgtgatattgttccttatatccaggcgaggggaaaataatattactctcaatatcgcaggaggtgtacacaccccatgtgatattgttcctaatattaagggggaaagaagataatattactttcaatatcacagggtttgtactcctttcttgtgatatagtttttagtatccagggggaaagagcatgatattactcccattgtagcaaggggtgtacacacctcctgtgatattgttcctaatatccagaagtggtgaggatgatattactcccaatatcgcagggggtatacaccccacctatgatattatttctaatatccatgggaaaagagtatgatattacacccaatgtcgcagagggtgtgtatttttcctgtgatattgtttctaatattcaggcggggagaagatgatattactctcaatatagcagaaattgtacatccccgctgtgatattcttcataataatcagggaaaaagaggatgatattactaccaatattgcaggggggttacacttcccctatggtagtgttcctaatatccaggaagaaagaggatgatattaatcccattatccaggaagtgtacacccaccctgtcatgttgttcctaatatccagcagggaagaggatgatattacaccccccccccgtgatattctccttaatatccaggaggggagaggctgatattactggatatatagcaggggtgttcataccttctgtgatattgttcctaatatccagaaaaggagaggatgatattacttccaatatcgcagaaggtgtacacctccctgtgatattgatcctgacattcagaaggggagaggatgatattactcaaaataccgcagggcatgtgcattcccttgtgatattgttcctaatacccagaagggaacaggataatattactttcaatatcgcagggagtgcacacccccctttggtatggttcttaatatccagaaggaaagagggtgctattactttccatattgcaaggggtgtacaccccactgtggtatggttcataatatccaggcagggagagggtgctattactccccacagtgcggggcatgtacaccctgctgcggtacggttcctaatatccagggggagagaggatgctatgactccctatatcgcggggtgtgtacacccctgtgtggtatgttttgtattctccaggaacggagagggtgttgttacccctcatatcgctggaaatgtacactcccctgtggtatggttcgtaatatccaggggattgagggtactgttacccccatactccccatatcgtggggggagtgcacctccctgtggtatggttcgaaatatccagggtaagagagggtgctattattccccattttgcaggaggcgtacacccccctatggtatggttcgtaatatccggggtgaggggatgctatcaaaagaagagagaaagagaccccccatattgttctatattattttatactcagtacctgttttaagaagaaacaaggaagtgaaaccaaaagcaggcagcccggcgccaggcaccagacccaaaaccagacccgaaaccaggcctgggcctgcctgaccttagcctgatagttaaaattcaacccatgacctagcaaccaatgttatccatagattccagacattgtatggaaggacattgtgaaatttcttgttctgtgctgtttcactctgattaccggtgcctgcagcccctgtcacatacccactagattgctcaatcaatcatggccctttcatgtaagatctttagtgttgtgagcccttaaaaaggacagaaattgtgcactcaacaagctcggattttgagacgctagtctttcgatgcttccagctgattaaaagccacttccttcactacctcggtgtctgtggggttttgtccgcgactcctcctgctacactatgactccccatatcaaggggggtgtacacccccctgtggttcgtaatatccagcaggggaaaaggtgctattactccccatattgcagggagtgtacacccccttgtagtatggatcgtaaaatcaaggggggagggaaggtgtaattatccccatatctcagggggtgtacacccctttgtggtaaagtttgtaatatccagggatattacagggatattatccccaaattaatacttttataatttcttatgcctgcctttactgcaatctctgaacataaattgtgaagatttcatggacatttatcacttccccaatcaatacttttataatttcctatgcctgtctttactttaatctcttaatctcatcatctttgtgagctgaggatgtatgtcgcctcaggaccctgtgatgattgcattaactccacaaattgtttataaaacatgtgtatttgaacaatatgaaatctgggcaccctgaaaaagaacaggataagagcgatgttcagcgaacaagggagataagcataaggtctgactgcctgtggggctgggcagaacagagtcacatttttcttattgcagaaaatgagtaggagaaatatcactgggaagggaacgcattcctaggggaggcctatggacggccgctctgggggtgtatcccttatgtggttgaagataagggatgaaatacaccctggtcccctgcagtgccctcaggcttgctaggattagaaattccagcctggcgaattctagtcagaccagttctctgctcttgaaccccgtttcctgttaagatgtttatcaatgacaatgcgtgcacagcaggacatggaacctcaatagtaattccattttctccctggccttgtgaccttgctaggcccttctgcccttgtgatcttttattgccatttgaagcatgtgatctctgtgacccactccctattcgtatccccctccccttttgaagtccctaataaaaacttgctggttttgcagatcaggtggtcatcacagaacctgccgatatgtgatgtcaccccggaggctcagctgtaaaatttctctttcgtactctttcactttatttctcagaccaggtgacacttaaggaaaatagaaaagaacctactttgaaatattgggggctagttcccccaatagacattgttcctaatatccagaaaaaaagaagatgatattactcccaatatcacaggggttgtgaaccccacctgtgatatggttcctaatatccaggaagggagagaatgatattactctccatattgcagggggtgtgcacatccctgtgatattgttcctaatatccaggggaggagagggtgatattactcccaatattgcaagggttgtaaactccaccctgtaatattgctcctaatatttaggatttagggggggagaggataatattactcccaatatcgcaggggatgtatatgccctctttgatattgttcctaatatccagggggggagaggataatattactttccatatcacaaagagtgttcacccccctgtgatattgttcctaatatccaaaaaggaagaggatgatatcaatcccaatatcacaggaagtgtacaccccccccttttatattgtttctaatatccaggggaaatgagggtgatatttctctcaatatagcagaatgggtacactccccctgggatattattcctaatatccaggggaaaaaaagaggttgatattcttcccagtatagcagggaatgaatacaccctttgtgatattgcttctaatatcaaggggaaaagaggatgatatgactcccaatatcacaggggatgtaaacctgtggcgttgttgctaatatcaaggagggaagagtatgatattactcctaatgtcgccgaaggtgcacactttccctgtgatattgttcctaatatccaaaagggaagagaatgatattacccccagtattgcagggtgtacaccacccctgtgatattgctcctaatacccaggaaaaaagagaatgctattacccccaatatctaaggggacgtataccttccctgtgatattgtttctaatatccaagtggggagaggatggttttactctcaatattgcagggagtgtacactccccctgtgatactgtttctaatactcgggctgggagaaatagtattactcccaatatcgcagtgatattgtttccctgtgatattgtttctaatatctagtgggggagataattatattactaccccatacacaggggagggtgtacattcccctgtgatattgtttgtaatatccagggaaggagaggatgttactcccaatatcacaggggttgtacaccccttttttgatattgttcctaatatctggggggcagagaattatattactgtcaatatcacagagtgtgtacaccccctctgttatattactctttatattcagggcggtagaggatgatattactccctatatcacagggggtgttcacccctcctgtgatattgtttataatatctaaggggaaagaggatgatatcactctcaatatcaaaggaaatgtacacctttcctgtgatattgtttttattatataggggggcagaggatgatattaagaacaataccacaggggatgtacacccacgtattgatattgtccctaatatgtatggggaaagaggacagtgtaactcccgatatcgcagagtgtgtacacccccttgtgatattgtttctgatatacacggggagaaaagataatatttcttccaaaattgcagggggtgtacaaccccctgtgatattgtttttaatatccagtgggggagagaatattactcccaatattgcagggcgtgtacacaacccctgtgatattgttcctaatatccagagtaggggaggatgacattactttcaatatcgcaaggggtgtacattcccctgtgatattgctcctaatatccatgaggggagaggatgatattattcctaatatggcaggggctgtacaccttccctgtgatattgtttctaacatccagtgggggagaaaatgatattactccctatatcacagaaggtgtacactttccctgtgatattgttcctaatatccagaaggggagaggataatattactcccaatatcgcaggaagcttacaactcccctgtgatattgtttctaatatccagggaggtagggatgatattactcccaatatcgcaggggatgtacactcccccgtgacattgtttctaataaccagggggtgagaggatgatattacgcttaataccgaagggggtgtacacacccttgtgatattgtgcctaatagccagggggaagaaaattatattaattttaatatttatggggaaaaaggatgatattactcccaatatcacaggggctgtacaccgaccttttgatattgtttttaatatccagaagagaagaggataatattgctcccaatatcagaaaaggtgtaaaccccttctgtgatattggtcctaatatccagggagggagagaataatattactaccaatatcacagaaggtgcccacccccaaggtgatattgctcctaatatccaaagataatagggtgatgttactcccaatatcacaggaggtgttcacaccccttgtgatattgtttctaacgtacagggaagggagaggatgatattattcccaatatcacaggaggtgtatactcctctgtgatattgattttaatattcggggggaaaggatgatattactccctatatcgcagagggtgtacaccctctgtaatattgatcctaatatccagggcgggataggatgatattactcccaatatcgcagaaagtctacacaacccccagtaatattgtttttactatccagggggaagaggatgacattactcccaatttcacagagtgtgtacactcaccatttgatattgtttctaatatctagggggagagaatatattactcccaatatcacaggaattgtacaccacctctgtgacattcttgtgaatatccggggaaaaagagaataatattactcccaatattgcagagcgtgtacacccctccatgatatcgatactaatatttttttaaagaggatgatattactcccattgtcacaggatgtgtacaccccccttgtgaaattgttcataatattctggggggagagcataatattactccccatatcgaaaaaggtgtccaccctccttataatatggttcctaatatccaggatattacttaatccaggatacttgtaataccctaaatatacaattgcttgaacctccacctcccaggttcaagcaattcttctgcctcagcctcccgagtagctgggactacaggggcacaccaccacacccagctaatttttttttcttgtatttttagtagagatggggttttgccatattggccaggctggtctcaaactcctgaccttgtgatctgcccacctcagcctcccaaagtgctgggattataggcgtgacccaccgtgccaagccaggaagaggatgctctatagatttccccaataagagatggctttgcagggccattccaaaatatgtcaaagaaatacatttggggataaaatactttgatttcctttagggaatgttatctattatgtgatgctataccagagtcaggttggagtcggttatcttattgcaacaaagagtctgttccgtcactgttgggatctctattttttcctcttatttcttgagacagggtctcactctgtcacccagtctggagtgcagtggtgcgatcttcattcactgaaacctctgcctcctgtgttcaggtgattctcgtgcctcagccccttaagtaactaggattacaggtgtgcgccaccacacccagctaatttttgtattttcagtagagatggtattttgccctgttggccaggctggtcttgaactcctggcctcgtgtcatctgcccacctcgacctcccaaagtgctgggactgcaaatgtgagctattgtgcccagccaggatctctgttttaatgttagtgctggtcactttgcatgaactccaaagggaagaaatataatgaggtgtgtctgaccccctgccttctcatcgtgacctgaattagtttttcaggtttgcaggggatacccttggacaagaaggggctctattcggttggttggggggattagaattttactttttgtttacaatatttctcctgaaagagttaggggctcacaaggaatttccgcgtgagcaacttatgaggaaagccatctgggaagatatgtgtccttgtgtcactgggatattctcgtttaccccaatgatacggcaatgacgcagggttgtgaaattacagctatgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgctacactaagcttagatttcagtgaatgtgagtctcagccactagctcagagccacctcccaaagaccaaatcatgtagggacaatagaaagtacttctgagaattgtggttaccaagaacctagtaactgttggggaggagcaaaacaaagtacagaaaccagagggtacaatctgagtgagactgctatcagcttctggaggagcctttactaaaatgaatgatgagagtaactggatgatgagagtaactaatggatgatgagagtaagcaatgtctttggttttcttttttttttttttttttttttagcagacgtctcactcttgtcgcccaggctggagtgtaatggcatgatctcgcctcactgcaacctccacctcctgggttcaagcaattctcctgtctcagcctcccgagtagctgggactacaggcactcatcaccacacctggctaatttttgtatttttagtattttctggtgagggtccaggtttccggaaacaactcagagacatatgttaagatgttatctttagttttcacagggaaccaaatatgttacgactccaatttccttggctattgttttaagttaccattaccttctcgttgatcaagttgctcatttacttctcaagcctagctagatgcctggaatttcccttgaaggaagtcaagattttcctttatctccatactggctgatggtgatcgagtaagcccctaagaggggtccctgctccatctcgagatgctgctagattctacagtgcctaataaacagctctcgcctggccgacaaagagctgcttgctctctggatagcaattccaaagtgaacagacaacatcctgtttggaagactgccactctgttagaagaagcatcaggaaaacctttcttttgagctatttataactaacagcaattgaccaagtatacttttgtgagtgaaactgacctttctccctgtaagaattctccaaaatttggaaactatttgtgagtatttttacttatggcaatataattattggcacaagctcaatcagattcggttttctttcgtaacaggaaccattggagatactcattactctttgaaggcttacagtggaatgaattcaaatacgacttatttgaggaattgaagttgactttatggagctgataagaatcttcttggagaaaaaaagactgggtatattttcaatatgctttccttttaaggtccctcacctgtggaaagtaaagaatgtcactttctgacaggctcaggaacctcaagttatgtagggatctcaagaagatgggggaattcacccagttcatacaggtgaaattgctgttgcaaagattatgaatatgagagaagtccagcatggctgacttcatctcgtgtctggcctcaggctggctgcccttgctcactcttgggcataggccaagctagccatgggaggaatttagtttatagtttaactttgaagcacggatgataatagtctctccctaaaatgaaccccttccttgctcagggactgaaactacctttgtatgacaaatgaaagcccacaagattaagattatgagaggggcctgaattctgctaaaatgcaggtgtagctgactgataacaagtcattgtcccacagcttgcctttctataatctcttgcttctcaggagtcacatggccagaggtcctgagatttccagtcctgtgacccccacccagagatggacttagtgcatgaggaccattttccacacccctatgatttcatcctcaaacaatcagcagcaaccattccctagccccctgccttccaaattatccataaaaatcctagcctctgagttattagggagattgattaataatcccagtcctaccccttgggttgctctgatttaattaaaccttctctactgcaataccacggactcagtaaattggttttgtctgtgcaatgggcaagaagaacatgttgcatggttatacaggtactacaagcacagtctgatggcaaattattggttttgcttcctgcccttgatgtttctaaacatctagtccaaaattacttgtgaaaggtccagcaaagccaattttaaaagaggctatatggccaatcactattctttctacacattattgcaaataatcaggccacggctgggcacggtggctcatgcctgcaatcccagcactttgggaggctgaggcaggatcacctgaaatcaggagttcaagaccagcctaggcaacatgataaaaccctgtctctactaaaaatacaaaattagccaggcatggtggcatgcacctgtaatcccagctacttgggagactgagggaggagaatcacttgaacctgggaggcagagattgcagtgagctgagatcacaccactgcactccagcctgggcaatagagtgagactttgtctcaaataataataataataatcagaccaagtataatgaaattaaaatttattttgcaaataaattggtcctactacaatttatccttcatagaaatgtggaaactgaagataaaaaaaattaggtttcagaagaaaactatactacacctgttattagattctagccctaaacattgtttttgaggtttttattatttacctgcaatttggtctaaattctgaattatttcctgactacaagtatccaaggaataaatgggttttctttttctttatgatagttttagttggcttctaatgcaacaacaatttttattgtaatcctgtgtgcattctattcctactattcaaattattaatgttatagatctttcattgtagtacttctgaattaaccaaaatcacagtattctgaagatgattctacaaagcctgctgtttctacaaaggctgctgatgatttctacaaagcctgctgtagtgttgctgtggcctctgcttaaaaaagtagaaaacacattgatgcagcatgttcaccccaacctccctgcctaaaggctcagggaccatcttggaagaggaaggcgcgtgagattgtaagagccgaattagggggatggagtgtggagaataaggacacttcatcttggatgctcacctgccaaattgacttctgatgaaagccagctccagaaatgtgcctacagttactactttcacctaaaccctgcccttagtcaaatccttctcttcttctaagcaatcaacttcaattccttgtataacccacagtataaaagggcttttataccattctatcctattgcatgtaagccttgggtctgggaggtaacagtgtgggattccaccatctcatctccctgccacccaaacatgcctgctcttctttaagcaatattaaatgtttgtacttcagaaatttgatttgtcagcctcttcttcagactctcagcttctttggcctttgggagtaaatttgcataggcctgctcaaaacaggatgttctgggggtttgggggtgttgttttgttttgttttttgttttgtttagagacagggtctcactctgtcacccaggttggagtgcagtggtgcaatcatggcacactgcagcctcaaactcctaggctcaagcaatccccccaccttggcctcccaaagttctgggattacaagcataagccaccatgcccagccctggacttttctttaaagacatttacacagtgtaggaattactgtgggtgcactgctcaggtccccttctccaggatgctcattcctacctcatagatgattttcctgcagagatttgacctcagctgaagggcagtcacctggtccaggtggttgctattcacctccttcctgagaacagccaacagccagggacacgctagcacagagatataagagcgaccaaggtgaggccccttctgtgctgcggtgcatgctccagagcctccctgggatcagacttaagagggtctccagccagatctggtcttcgctgctttcctcgagctccccagcgcactcctgcaatgcatcttttttttttttttttttttttttgagacggagtttcactcttgttgcccaggctggaatgcaatggcgcaatctcagctcaccacaacctctgcctcgcgggttcaagtgattctccttcctcagcctcccaagtacctgggattacaggcatgcaccaccacgcccagctaattttgtatttttagtagaaacgggtttctccatgttggtcaggctggtttcgaactcctgacctcagttgatcctcctgcctcagccttccaaagtgctgggattacaggtgtgagccactgtgcctggcccaatgcacctcttgaatcacctcctcatgctttgcttttagagaacatgatccccaacatgtgattccagcaaagattctagaaagccaaccgtgacaatcacttctgggtttagatgacccccccccaccacaagatggcagtgagcacctcatcacagaggtgctgatggtctgcagcaccgcgccaggccagaacgtgccttttacagaagaaaataacccagtagctgactaggatggtgaggagggctggtgagcactgcggtagtgagagggacactagcatcactgagatgcaagtgatggtcatttttcataggtcaaagctcaaagcaggggacagttacagggcagggcttcatagcaccagtgtgatgaaagtatctgggagtggctaaggccagcactatgccatgggaagcaaggtgggcctgaggaggaggcagcagcgtcagcctgcaacaagtgggggctgccctgcagagacctaagagtcatgttatagagcacagtgtctgtaaggccaagaagtgtggacagccaagtgtgtcaattactagacatactcaagaggagcaggaagggcagggcatggtggctcatgcctgtaatcccagctacttgggagactgaggaaggagaatcgcttgaacccgggaggtgaaaattgcaatgagccgagatttcgccactgcactccagcctgtgtgatgggagcgggactccatctcaaaacaaaaaaagaaaaaggaaaaagaaaaaaagaaaaacctaggtatacttctcaagcaaataaaaataatcaaaaccaatatcatgcccgggcacaaatttcatatatataacagatttaaatatatgagggtgattatcctctcatatctccatttttttttgtttttccatttttttctttactaaaaaaagttaatgccaatgacacacaatttttttttttttttttttttttgagatggagtctcacttcttcgccctggctggagtgcaatggcgtgatctcgactcactgcaaagtctgcctcctgggttcaagcaattctcctgcctcagcctcccaagtagctgggaccacaggagtgagccaccacacccagctaatttttgtatttttaatagagacggggtttcaccatattggccaggctggtctcaaactcctgatctcaaataatctgcccgcctcggcctcccaagattctgggattataggcgttgagccactgcgccccgcctatgtatgattttttttttaattttattttcataagtttttggggaacaggtggtattttgttacatgagtaatttctttagttgtgatttgtgagattttggttcacccatcaactgagaagtatacactgaacccaatttgtggtcttttatccctcacccccttcccaccctttcccccggagtccctgaagtccattgtatcattcttatgcctttgcatcttcatagcttagctcttgaacccttactttctgtttgagggagaagacatatcatctacaagtagatactgtgtaaacattccattgcatgactatcccataacttatttattatttgtgtttggttatttgctgctatgtaacaaccccactcccaactaaatggtgtgacaattccatgattctgtggatcaaaaattctgaaaagtcaaacccaaggagttttgtctctgctccatgatgctaaagcctccgcaggggtgaggcgaatggctcagggtgactgaaaagctcagggttggaacagctggggatgaggcctctatgtataagatgattcttcactcacaggtctgaaactatggtggggacagccagaaggctcggctcagctgggacagtcacctgagccctacacatgacctctccaacatggtgatcctgaagcagttgggtttcttacacagcatcacacttttcttttttttttttttttttgagatgaaatattgctctatcacccaggctggagtgcagtggcacgatctcagctcactgcagcctccgcctaccaggttcaagcgattctcctgctccagcctcccaagttgctgggattgcaggcgcctgccaccaagcccagctaatttttgtatttttagtagagacggggtttcaccttgttggccaggctagtcttgacctcttgacctcaggcgatccgcctgcctcggcctcccaaagtgctgggattacaggcatgagccaccgcgcccggccaaagctcacacttcttatgattcagccttagatgtcacatcagttcattttccccacacttattagtgttagaagtcacaagcccacccatactcaggggactggcacacagaccccactctcaatggaaggggtgggacaccaccattcctgctgatgggcatttgggtaacttcctgtttgaagctattaagattgggctgctgtggccgggcgcagtggctcacgcctctaatcccagcactttgggaggccgaggcgggcggatcacgaagtcaggagatcgagaccatcctggctaacacggtgaaaccccgtctttactaaaaataccaaaaaaaaaaaaaattagctgggcatggtagcgggcgcctgtagtcccagctactcgggaggctgaggcaggagaacggcgtgaacccgggaggcggagcttgcagtgagccgagattgtgccactgcactccagcctaggcgacagagcaagactccgtctccaaaaaaaaaaaaaaagattgggctgctgtgactattctagtaggtgtctttggtgagcgcctacacgtgtttctctttttctctttagtatatgcccaggaggggaactgctggctcccagataccgtatgttcagggtcacacacacttccacagggttttccaaagcccttgtaccagcacgcactcccagcacctgtgtgactgctccagctgtcccacagtctcatcagttctattgctgatattttcattttagcttaagttatatttaataggaaaattaccgttgcctctgccccccgttcctgcctgtaggagtttctcgtagctgttgctacaggtggccacaaatctgtcacttaaacccacacaaattgatgtccttatggctttggagtcagaagtgtcaactgaaggtactagcagggctgtactgacctggtggcctcagggagcatctgtgctgcttctccaccttctagaggctgctgcatccctcgctccagccccttcctgacaccactcaccctcctacttctgttatcacatcctcaccttctctgtgttcagggctccctctgtctctctcttgcaagcacacttgggattccattgagggccacccacataacccaggagaatttctccacctcaatatccttaacaactgcagagcccttttgccataaaagttaccattcacgggttccagggattgtgacatgggtagctttaggagtgattattcctgcctgtctcccgctcaccagaacttggactttctctctcaacaggagccccctgtgtgggaatagcctgtctcaacgacgccctctataaggacctgcttcctcaaaggacctcatagtcgggtcctgcccctcagtgtccagtctgccttggctggaggggctgcaggggtgtgttggcgccacctggtggagacagggcatcacagcaggtgggagcccagtagaagcacaaccaaaacatgggtaatgtttaaaattttctggctaagcgctgtggctcacgcctgtaattccagcactttgggaggccgaggtgggtggatcacatgaggacgggagtttgagaccagcctggccaacatggtgaaacatcccctctactaaaaaatacagaaaaattagctggacatgtggcgcgctcctgtaatcccagctactcgagaggctgagacacgagaatcgcttcaaccccggaggggttgccgagatcgcgccactgcactccaggctgggcgatagagcgagactctgtctcaaaaaaaaaaaaagaagaggggaggcgaggggaggggaggggaaaagggggaatttgtttggagctgagacatccatcttctcctgacctcagatatttgcactcctggttatgaagccttcacacttggactgaatacaccaccagctttcccgatttccagcgtgcaaatggcagatcgtgagacttctcagcttccataattacatgagccaatttatatatataaattgggtcctccagaaaaacagaataaattatatatataattatacgcataacttaattaaattatacgtataacttagctatatatataatttattctgtttttctgaagaaccctactgacacaaatgttgagcatcttttcatgtgcttattggcttaataacttgtacatcttctttggggaaatgtctattcaagttctttgcccattttgtaactgaactattaatatttgtctttacattgttgagttgtaaaagttccttatatattctagatactagagccttatcagatatatttctgcaactattttctcctaatatataggttgtgtttttattttctttttctttttttttttattgagacagtctcactctgtcacccaggctggagtgcagtggcatgatcttggctcactgcagactcgacctgccaggctcaagcaattctcccacttcagcctcctgagtagctgaggttataggcacttgccatcgcacccagctaatttttgtattttttagtagagccgaggtttcgccatgttgcctaggttggtcttgaactccctgcctcaaagcgatctgtcagcctcagtctccctaagtgctggaagtacaggtgtgagccacagtgcccggccatctattttcaatagtgttttttgatgtacacaggtttggaattttgataatgttcaattcatccatttttttttttttttttttggttctttctactggaccaccactcttgagccctctaatccaacctccacgcggcagccagagggagctctctaaatgtaattactctttccctgctccacctgctcaaaacagtgtcacatttgtgatttaaaacagtatttctcaaacctaatttgcaaacaaagcaggtggaactcttcttgtatgcacagcatctgatttggttggtctggcatgggtctgggagtgagcacacctaccaagcggctgctggggtaacttgcgttttccactgatgatttcagcaatgtttccggtcccacatgctcctccagaaccttgtactcccccatgaaaaggtggagtccatttccccttcctttatttatttttttgagacgaagtttcactcttgttgcccaggctggagcgcaatggcgtgatctcagctcaccgcaacctccgcctcctgggttcaagcaatgcttctacctcagcctcccgagtagctgggattacaggtatgtgccaccacgcccagctaattttgtatttttagtagagacggggtttctccatgtcggccaggctggtctcaaactcccgacctcaggtgatccgcccgcctcagcctcccaaagtgctgggattacaggcgggagccaccgcgcccggctatttccccttcctttgaacctgatcaggacttgacgatggcatcaacatggtgagagtgaccctgcatggcttatgaggctgggttacacaaggcgatgttgcttctgactggctccctctcaggatacatgcccttggaacccatcctctaagctccttgggagcccaacttagcccatgtggagacaagacagggagagaaacagaggcacccccagccctcagccagcatcaaccgccagacaggagagcaaatgcgccaacaatgattccagctgaagcctcagacagcgtggagcagagatgagggatccctgcagattgcagatgcgtgagcaaaatgcatgctgtcactgttttgaaacaacaatgtctgggggctgtttgttatgcagcaatagacagctgtaacaatgctgttactgctgtattccatgaatgactgcactttgagtagcagggggctagatcactagataagccccatggcttctgtgtatgctatttttctacttttatatccttttcattcactttttttttttttttttttgagacagagtctcactctgttgcccaggtgggagtgcagtggtgcaatcttggcggactgcaacctccacttcccgggttcaagcaattattgtgcctcagcctcctgagtagctgcgactatagatgcacccccatgcctggctagtttccgtatttttagtagagacggggttttgccatgttggccaggctgatctcagactcctgacctcaggtgatccacccaccttggcctcccaaagtgctgggattacaggcgtgaaccactgcacccagcctcattcactttctttacttggctcatttttccttgttgcctcaattctcctctaagatcactttcctgacatttcagcctgggcctgttgccttctctgggtcccctccgcctcctgtgcctcccccatctcagccttgatccctcagattatacttcctctgtccccaccctgaccatcttggctgtccctggatagggatgggtatcttctcccactggtctgggagatctggaaggacaggcctggaaaagacttggtcactgctggaaggagctcagttagtgtggtgctgaggacagtacgggtgaggctggccccttcacccaaactcccactctcttccatagatttcacctctgtggcccaggccataggattagggcaactccccttaaacatcgagtccatcctccaagctgtccttttttttttttttttttttttttttgagacagagtctcgctctgttgcccaggctggagtgcagtggcgcgatctcggctcactgcaagctccacctccagggttcactccattctcctgcctcagcctcccgagtagctgggactacaggagcctgccaccacacccggctaattttttgtatttttagttgagacggggtttcaccgtgttagtcaggatggtctcgatctcctgacctcgtgatccgcccgcctcggcctcccaaagtgctgggattacaggcgtgagccatcgcgcccggcctcatgctgttcttgaatagtgagcacctgttacaagtcgccccaccagcctctcacttgtacccccctcatctctttctccccaagagacagaggaccctggcacttgtgaagcatgacccagaccctggggccatggcatccaacatcctcattccccatgacccctactgtctagatgtagctgccaagagacccccagactccccgggcctctgtctagagtgccaagacagagagagaatgccctgccgcttgcatgctttgtggggtgtccttcccccttccctggctgctaggcgtgacttcaacgttctccccaacccccaaacagcagcactgacaccagctgcagacctggctcaggttagctaatgaggaccaggctggggatggagcctgaacccctaaaccccagtcctgtaccccaccctaatcctggggtctccactggacaaaacgaagcagcttggtttttcgttgttattgtttttgagatagagtatctctctgtctcccaggttggagtgcagtggcgtgatctcagctcactgcagcctccgcctcccgggttcaagtgattcttgtgccgcagcctccccagtagctgggattacaggcgcgtgccaccacacccagctaatttttgtatttttagtagagacagggtttcaccatgttggccaggctggtctgaaactcctgacctcaagtgatttcccagcctcggcctcccaaagtggaagcggcttatttttaaggagaaaactcccgtggaaaggaatcagcacctcctctgtcaacatttcacttctctgaaaagactctcacttccaacagaaagtgctttgtaacacaacaatgaggctgggcgaggtggctcatgcctgtaatcccagcactttgggaagctgaggcgagtggatcacgaggtcagaagttcgagaccagcctgaccaatatggtgaaaccccgtctctactaaaaatacaaaaattagttccgtgtggtggcgtgagcctgtaatcccagctactcaggaggctgaggcaggagaatggcttgaacccaggagatggaggttgcaatgagccgagatcacgccactgcactccagcctgggcaacagagtgagactccgtctcaaaaaaaaaaaaaaaagaatgagaacatatggacacagggaggggaacaatacacacaaacaaaatttagaaacaggtgaaaataattttagtaatatttttactaatactgatatgctcaaaatattattatttcaataagtaatctaaaaattattgagatgtcttatgttcttttcatcatactaagcctttaatatttggtgtgtattttacactcacagcacatctcaatttgcagtccccatgtttcaagcactaaataaccatgtgtgtccggtggctaccatactggacagcgttgatctgaaatcgcatctgtatgcatcaccagcatatttgcagagatccccatctcagcagcacacctgaggctcatctgcgaaagcacctgcaacttctctacaacctcccacatcacctccaaacacatcctcatgtcatctgcaaacacacccatagctcacaggccaatgcctaaatatcattgcaggcaccttcagagaaagcacttactaaaggggtatacttgattccacatctgctttgacctgcaaatctcccttctcctttacatacatttgcatctcatttgtatgtcaatctaaatccactggcagagcctcagatcatcatctcaaagtcaggtggatgtggggctgggcaggcctccaggtgttcctcctcctgcttcctctggggctcttgatcctcctcctcttccttgctgctctcctcctcctcctccaatatggtgaccagttcctcccgcagcgcccccatctccagccccaggctgcacagctgtcccagcagctggacatccactcggcgcaggttcccctgccagtaggaaggggacgtcacagggatgccaccccagagagcaaggggtctctccaggacctgggtgagagcaggtcccaactcatgtcctggccacagcgcctgggcagggtcctcactgtgcccatggaccctaactgccttcctgcttctcagagtgtctcttgatctctaactcttctctttgtctctccatttcattgtccctgacttctctctctctgtctcctccctctcttatctatatctgtccctgtttccctttgtctctgtccccatttattttttgtctttccatgcccctgtctctctgtctttatgtgttgccatttctctgcccctgcctttggctctctttctctcgcttgccctctctctgccctccccaactttctcaaattcagtctgtctctccatctctgttcctgctctccgtctctgcttcccacctctgtccctctcttttgggatctccctgtccccacctctgttcccgtccctcactctatgtctgtctctcggtgtctgtacatgcctctcatgtctctgcttctatctctcagattctgtttttcgatctctggccttctctatttttgttcatttccattcattctcatttcctctctttctctttcccttccaaacccctcactcaccagctcctccctgatccacagcagactatcgcaggcacctccagtgtctgcccctgcagtcctgagggtctgaccagggatttccactggggagacctccctcagggcctgggggggtgggcccagccccggaggcaccagtccagcctgattcagctgcctccacagttccatcgtctctgagctatggctgcaaggagcaggaagtagcaaggtccagggtggcctggtcccctggggagctgtgtgcgtggtggagagtaaagggcagagggagtgggatgggggttcctgggaaaggtatcccaaagtccactcttcagagagaatcagctggccttgtgcttttctttttccttctgaagtctaacctcaactctgctcacagggttcaaacatagcctcttgcagaggtctaactccacccttccctgcctgtctcaggcctgacccctcaggggcgctcagtgtctgtagatgcctggcaccctctgtccttccacctgccccccaccaccacttctccagcctctcctcagcctccatttgacctctggcttgcccatagcttggtccttgcttgtcctcttggcacgggtcatcctagggctttcccaccagtgtgcctttgggggcaggaatggctcccaggggcaccaagacagcaatcccttagctggagtgcctgtgtccaggctgctggcctagggccaagcagccaattctgctgaccctggacttgcctatgggtatattatccctgttgagggtgagggcttctgctgtggaaaagtctgggaagcactgcaggcctctctcggccttggacccttccttcagacccaaggtgcatatatatacatatatataatggtagatcacgaggtcaggagatcaagaccatcctggccacatggtgaaaccccgtctctagtaaaacacaaaaaattagccgggcatgctgccgcgtgcctgtagtcccagctactcgggaggctgaggcaggagaatggtgtgaacccaggaggtggaggttgcagtaagccaagatcacgccactgcattccagcctggcgacagagcaagactccatcttaaaataaacaaatgaacaatatatatatatatgtattttgttttttgagacagagtctcgctctgtcatccaggctggactgcagtggtgcaatcttggctcactgcaacctccgcctcccgggttcaagcgattcccctgcctcagcctcctgaacagctggggttacaggtgcacgccaccacacctggcgaatttttgtatgtttagtggagacggggtttcaccatgttagccaggctggtctcaaacccctgacctcaggtgatctgcccacctcggcctcccaaagtgctgggattacaggcgtgagccaacgcgcccagccccaagtcccttttaccatagaaagtaacatagtcacagtgcccagggattcacaggtatggggagagggttcgttattcagctgccacacccaccttcctaaacctgctgcccttccagtttcctcacgtgcacagccacgcccgtctgcttttagtttctcaatctgttggcttaaccttcaaaacaggcccaggatttgagcacttctcaccattccctctgccccatccccattcatctcttgcctagactgctacagcagcctcttttactggtcccctgcatccacccttgccctctaaggcaagggtccccagtccctgggccaaggaccagtaccagcccctcgcctgctaggaactgggccgcacagcaagagatgagcagcgggtaagtgagcattaccgcctgagctccgcctcctgtcacatcagcagtggcattagattctcataggaggcaaaccctattgtgaactgtgcgtgcgggggatctaggttgcctgctccttatgagaatctaatgcctgatgatctcaggtggaacagtttcatcccaaaaccatccccaccccacccccgacccccagtctatggaaaaattgtcctccacgaaaccagtccctggtaacaaaacggttagggaccgctgctctaaggtacattctccacctggcagaaataatctttacaaaatgtaaatccgattttgacactcccttcttcccactgtgaatagaataaaaccctaccaggcctgcaccgtcagcccctgcccacctctcaacccagtctcctatctctgtctgcaagctggttcccacctcaaggcctctctgctctagaggctacctctccctgcagcgcttttcccctagatctttgaatggctctttccttatcattcacttctacttcaatgtcacctcttcagagaggcctttgctgatggccctacacccagtcacttttttttatctgcttctcatcaaaattgccttgctgattcctttgtttcttattcatcctctcccacatccatcctctcccagcccagaatgttgacttcctgagagagggactgggtctgtcctgctcaccatggtaacctcggcatctagaacagtgcctgccatcacgtggtaggtgctcagtaaatattcttggaactaatgaatgaataattctatccacaagacttcacaatggctcttcatgctgcgatctagctttcaactccaaactggtcttgagatctcacctcagtctctaaccttgacatctaacctcttcacccactctcttacctgaccctaatttttaaaaatgacgtggtcagcttttcagccccctcattccctgtttttaggaggtagtgagtggaagctggaagaataagaaagcttggggagactgcaattgcagtcaggaaagaaaggtactctgccgggaagaacaccccatcttctcctagggaaagattgtggagtcctggggtttgttttgtttttcaattttttgttttaagagacagcgtctcgctctgtcacccaggctggagtgcagtggcgcaatcacagctcactgcaacttcgacctccccggctcaagtgatccccccgcctcagcctcgtgagtagctgggaccacaggcgtgcaccaccacgcccggctaacattttattttttgtggatataaggttgccctatttctttgtggagataaaggctcccctatgttgcccaggctggtctcgaactcctggcttcaagcgatgctttcgcctcggcctccacaaagtgctgggttcacaggtgcgtgagcccgacctgtgtctcgttttgaagctcagggagagggcgctgtgagcaatccctaaaccctttaagagtaaaaagtgcgtgcacctttaagaggacggttagaaaacgcggggcgtggccacaggagaataagttcgcgctgaaccaggagcgtgggataagaccggccccttccggttacgaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatactccagttcctgaccaactatttctacgatgtggaggctctgagggattacttgctccaaagggagatgtacaaggtgcatgagaaaaatcggtttcgagacaaggagtggatcaggccagataagtatggccatttctctcaggagttctggaatttctgtgaagtgcctgtcgaagctgtggatgccggtgactgtgacatcaactacgagggcctggataacctcctccgcctgaaggagctccagtccttgtcgctgcagcgctgctgccacgtggacgactggtgtctcagccgcctctacccactggccgactcgttgcaggagctctcgctggccggttgcccccgcatctccgaacggggcctcgcctgcctccaccacctccagaacctccgcaggctggacatctcggacctccctgccgtgtccaaccctggcctcactcagatattggtggaggagatgctgcccaattgcgaggttgtgggagtcgactgggctgagggcctgaagtcagggccggaggagcagcctcgggacacagccagccctgtccctgcctagcctttagccctgtccccactcacgtggcttctcagcgggctgcatggaatgtctggtagctcaccacacttctggcttccatttgtcttcactcaacgtcagggtgggggagtggtgctggccaatcacaggagagagcgtgagttcccagtatttattcctggctgcccttggctaaaggtcacagctcctgtcaccctgtcaggcagccctttccatgcccctgttcaggcctggggaggtaaaggctcaggctgttagtagccgcagagagccacactcaccttgtcaggagactcttctcaaactgtccttatgtgagtgcactgccatttcttgcagggaccctgactgacacaggggctactactgacactttacagggatggttctcccccgtgcagggccgctgtgcccactgcaggacatgcagcatccttcgccccactccactcactaaaggccagcgcaccccaggccccatagtattgctggttatggatttattgactttatgttccaaattcagctttttcagttggctgttttttgaaaggggataagctttgtcagtagagggcaccgaacaggcattataggaggaaaggcgcctccttcgtggttcttgttggcctccactgaggcacctctctgggaataacgttccccagcaccccaaatggatttccagtcaattcagaagcattttaccagtgaagccctcattattccagttcactgttaaagccagtaattctctatattaaactttccctgttcggtttatactccggagtataaaccgaacaggggtggccaagctgctgtgggccgccgccgtgcagaaccgctggaactcacgcttggggcgacggctacagttggattttgcccctgcaggcaggttcggtgtcgatactggcgttgatagcgctgctgccgtttgacgtggcgaatatgggcttgtttctcggcctgatcgccgtgttgtcgtagttcgcagccacccagga
